United States Patent
Ciaramella et al.

(10) Patent No.: US 10,124,055 B2
(45) Date of Patent: *Nov. 13, 2018

(54) ZIKA VIRUS RNA VACCINES

(71) Applicant: ModernaTX, Inc., Cambridge, MA (US)

(72) Inventors: Giuseppe Ciaramella, Sudbury, MA (US); Sunny Himansu, Winchester, MA (US); Eric Yi-Chun Huang, Boston, MA (US); Tal Zaks, Newton, MA (US)

(73) Assignee: ModernaTX, Inc., Cambridge, MA (US)

( * ) Notice: Subject to any disclaimer, the term of this patent is extended or adjusted under 35 U.S.C. 154(b) by 0 days.

This patent is subject to a terminal disclaimer.

(21) Appl. No.: 15/674,585

(22) Filed: Aug. 11, 2017

(65) Prior Publication Data

US 2017/0340724 A1  Nov. 30, 2017

Related U.S. Application Data

(63) Continuation of application No. PCT/US2016/058324, filed on Oct. 21, 2016.

(60) Provisional application No. 62/351,255, filed on Jun. 16, 2016, provisional application No. 62/247,390, filed on Oct. 28, 2015, provisional application No. 62/247,445, filed on Oct. 28, 2015, provisional application No. 62/247,595, filed on Oct. 28, 2015, provisional application No. 62/247,347, filed on Oct. 28, 2015, provisional application No. 62/244,814, filed on Oct. 22, 2015, provisional application No. 62/245,207, filed on Oct. 22, 2015, provisional application No. 62/244,937, filed on Oct. 22, 2015, provisional application No. 62/245,031, filed on Oct. 22, 2015, provisional application No. 62/244,950, filed on Oct. 22, 2015.

(51) Int. Cl.
| | |
|---|---|
| *A61K 39/12* | (2006.01) |
| *A61K 9/00* | (2006.01) |
| *A61K 9/127* | (2006.01) |
| *A61K 39/39* | (2006.01) |
| *A61K 39/42* | (2006.01) |
| *A61K 48/00* | (2006.01) |
| *A61K 9/51* | (2006.01) |
| *A61K 39/015* | (2006.01) |
| *A61K 39/00* | (2006.01) |

(52) U.S. Cl.
CPC .......... *A61K 39/12* (2013.01); *A61K 9/0019* (2013.01); *A61K 9/1271* (2013.01); *A61K 9/513* (2013.01); *A61K 39/015* (2013.01); *A61K 39/39* (2013.01); *A61K 39/42* (2013.01); *A61K 48/00* (2013.01); *A61K 2039/51* (2013.01); *A61K 2039/5254* (2013.01); *A61K 2039/53* (2013.01); *A61K 2039/55511* (2013.01); *A61K 2039/55555* (2013.01); *A61K 2039/575* (2013.01); *C12N 2770/24034* (2013.01); *C12N 2770/24134* (2013.01); *C12N 2770/36134* (2013.01)

(58) Field of Classification Search
None
See application file for complete search history.

(56) References Cited

U.S. PATENT DOCUMENTS

| | | |
|---|---|---|
| 3,906,092 A | 9/1975 | Hilleman et al. |
| 6,500,419 B1 | 12/2002 | Hone et al. |
| 6,514,948 B1 | 2/2003 | Raz et al. |
| 7,001,890 B1 | 2/2006 | Wagner et al. |
| 8,217,016 B2 | 7/2012 | Hoerr et al. |
| 8,673,316 B2 | 3/2014 | Kinney et al. |
| 8,691,961 B1 | 4/2014 | Puffer et al. |
| 8,734,853 B2 | 5/2014 | Sood et al. |
| 8,754,062 B2 | 6/2014 | de Fougerolles et al. |
| 9,000,141 B2 | 4/2015 | Chang et al. |
| 9,267,114 B2 | 2/2016 | Yamshchikov et al. |
| 9,464,124 B2 | 10/2016 | Bancel et al. |
| 9,512,456 B2 | 12/2016 | Wang et al. |
| 2003/0092653 A1 | 5/2003 | Kisich et al. |
| 2005/0032730 A1 | 2/2005 | Von Der Mulbe et al. |
| 2005/0059624 A1 | 3/2005 | Hoerr et al. |
| 2005/0250723 A1 | 11/2005 | Hoerr et al. |
| 2006/0172003 A1 | 8/2006 | Meers et al. |
| 2007/0280929 A1 | 12/2007 | Hoerr et al. |
| 2008/0025944 A1 | 1/2008 | Hoerr et al. |
| 2008/0171711 A1 | 7/2008 | Hoerr et al. |
| 2010/0203076 A1 | 8/2010 | Fotin-Mleczek et al. |
| 2010/0239608 A1 | 9/2010 | Von Der Mulbe et al. |
| 2010/0291156 A1 | 11/2010 | Barner et al. |

(Continued)

FOREIGN PATENT DOCUMENTS

| | | |
|---|---|---|
| CA | 2473135 | 6/2003 |
| EP | 1026253 | 8/2000 |

(Continued)

OTHER PUBLICATIONS

Heyes et al., Journal of Controlled Release, 2005, 107:276-287. (Year: 2005).*

(Continued)

*Primary Examiner* — Nicole Kinsey White

(74) *Attorney, Agent, or Firm* — Wolf, Greenfield & Sacks, P.C.

(57) ABSTRACT

The disclosure relates to Zika virus infection and the treatment thereof. The invention includes ribonucleic acid compositions, as well as methods of using the compositions for treating and preventing Zika virus infection.

26 Claims, 57 Drawing Sheets

Specification includes a Sequence Listing.

(56) References Cited

U.S. PATENT DOCUMENTS

| | | |
|---|---|---|
| 2010/0305196 A1 | 12/2010 | Probst et al. |
| 2011/0250225 A1 | 10/2011 | Fotin-Mleczek et al. |
| 2011/0269950 A1 | 11/2011 | Von Der Mulbe et al. |
| 2012/0009221 A1 | 1/2012 | Hoerr et al. |
| 2012/0219573 A1 | 8/2012 | Baumhof et al. |
| 2013/0022538 A1 | 1/2013 | Rossi |
| 2013/0121988 A1 | 5/2013 | Hoerr et al. |
| 2013/0142818 A1 | 6/2013 | Baumhof et al. |
| 2013/0156849 A1 | 6/2013 | de Fougerolles et al. |
| 2013/0195867 A1 | 8/2013 | Hoerr et al. |
| 2013/0195967 A1 | 8/2013 | Guild et al. |
| 2013/0195969 A1 | 8/2013 | Geall et al. |
| 2013/0202684 A1 | 8/2013 | Geall et al. |
| 2013/0243848 A1 | 9/2013 | Lobovkina et al. |
| 2013/0295043 A1 | 11/2013 | Kallen et al. |
| 2013/0336998 A1 | 12/2013 | Kallen et al. |
| 2014/0037660 A1 | 2/2014 | Folin-Mleczek et al. |
| 2014/0193482 A1* | 7/2014 | Bancel .............. A61K 48/005 424/450 |
| 2014/0206753 A1 | 7/2014 | Guild et al. |
| 2014/0271829 A1 | 9/2014 | Lilja et al. |
| 2014/0378538 A1 | 12/2014 | Bancel et al. |
| 2015/0141499 A1 | 5/2015 | Bancel et al. |
| 2016/0271272 A1 | 9/2016 | Bancel et al. |
| 2016/0317647 A1 | 11/2016 | Ciaramella et al. |
| 2016/0331828 A1 | 11/2016 | Ciaramella et al. |
| 2016/0367658 A1 | 12/2016 | Kinney et al. |
| 2017/0065675 A1 | 3/2017 | Bancel et al. |
| 2017/0130255 A1 | 5/2017 | Wang et al. |

FOREIGN PATENT DOCUMENTS

| | | |
|---|---|---|
| EP | 1083232 | 2/2005 |
| EP | 1905844 A2 | 2/2008 |
| EP | 2548960 A1 | 1/2013 |
| WO | WO 1987/005326 A1 | 9/1987 |
| WO | WO 90/11092 | 10/1990 |
| WO | WO 93/14778 | 8/1993 |
| WO | WO 95/24485 | 9/1995 |
| WO | WO 95/26204 | 10/1995 |
| WO | WO 95/33835 | 12/1995 |
| WO | WO 99/33982 | 7/1999 |
| WO | WO 2004/058166 A2 | 7/2004 |
| WO | WO 2004/076645 A1 | 9/2004 |
| WO | WO 2005/007689 A1 | 1/2005 |
| WO | WO 2005/009346 | 2/2005 |
| WO | WO 2006/056027 A1 | 6/2006 |
| WO | WO 2006/071903 | 7/2006 |
| WO | WO 2006/095259 | 9/2006 |
| WO | WO 2007/095976 A2 | 8/2007 |
| WO | WO 2008/052770 A2 | 5/2008 |
| WO | WO 2009/030254 A1 | 3/2009 |
| WO | WO 2009/030481 A1 | 3/2009 |
| WO | WO 2009/095226 | 8/2009 |
| WO | WO 2009/127230 A1 | 10/2009 |
| WO | WO 2010/037408 A1 | 4/2010 |
| WO | WO 2010/037539 A1 | 4/2010 |
| WO | WO 2010/042877 A1 | 4/2010 |
| WO | WO 2010/054406 A1 | 5/2010 |
| WO | WO 2010/088927 A1 | 8/2010 |
| WO | WO 2011/005799 A2 | 1/2011 |
| WO | WO 2011/026641 A9 | 3/2011 |
| WO | WO 2011/068810 A1 | 6/2011 |
| WO | WO 2011/069529 A1 | 6/2011 |
| WO | WO 2011/069586 A1 | 6/2011 |
| WO | WO 2011/144358 A1 | 11/2011 |
| WO | WO 2012/019630 A1 | 2/2012 |
| WO | WO 2012/019780 A1 | 2/2012 |
| WO | WO 2012/116714 A1 | 9/2012 |
| WO | WO 2012/116715 A1 | 9/2012 |
| WO | WO 2012/116810 A1 | 9/2012 |
| WO | WO 2012/116811 A1 | 9/2012 |
| WO | WO 2013/055905 A1 | 4/2013 |
| WO | WO 2013/090186 A1 | 6/2013 |
| WO | WO 2013/102203 A1 | 7/2013 |
| WO | WO 2013/120497 A1 | 8/2013 |
| WO | WO 2013/120628 A1 | 8/2013 |
| WO | WO 2013/120629 A1 | 8/2013 |
| WO | WO 2013/185069 A1 | 12/2013 |
| WO | WO 2014/144196 A1 | 9/2014 |
| WO | WO 2014/152774 A1 | 9/2014 |
| WO | WO 2014/152940 A1 | 9/2014 |
| WO | WO 2014/160243 A1 | 10/2014 |
| WO | WO 2015/024668 A2 | 2/2015 |
| WO | WO 2015/130584 A1 | 9/2015 |
| WO | WO 2016/092460 A2 | 6/2016 |
| WO | WO 2016/116904 A1 | 7/2016 |
| WO | WO 2016/184822 A1 | 11/2016 |
| WO | WO 2017/109222 | 6/2017 |
| WO | WO 2017/140905 | 8/2017 |
| WO | WO 2017/147458 | 8/2017 |
| WO | WO 2017/165317 | 9/2017 |
| WO | WO 2017/208191 | * 12/2017 |
| WO | WO 2017/208191 A1 | 12/2017 |
| WO | WO 2017/210215 | 12/2017 |
| WO | WO 2018/052549 | 3/2018 |
| WO | WO 2018/091540 | 5/2018 |

OTHER PUBLICATIONS

GenBank Accession No. KJ776791 (first seen on NCBI on May 12, 2014) (Year: 2014).*

Madden et al., Administration of nucleoside-modified mRNA encoding broadly neutralizing antibody protects humanized mice from HIV-1 challenge. Nat Commun. Mar. 2, 2017;8:14630. doi: 10.1038/ncomms14630. Available at https://acuitastx.com/wp-content/uploads/2015/01/Poster-Second-International-mRNA-Health-Conference.pdf.

Pollard et al., Type I IFN counteracts the induction of antigen-specific immune responses by lipid-based delivery of mRNA vaccines. Mol Ther. Jan. 2013;21(1):251-9. doi: 10.1038/mt.2012.202. Epub Sep. 25, 2012.

Tekmira, Lipid Nanoparticle-mediated delivery of messenger RNA (retrieved from the internet). Published Oct. 24, 2013. Available at http://files.shareholder.com/downloads/ABEA-50QJTB/2628241206x0x699789/47543d12-db34-4e6e-88a9-f3ae5d97b1d2/MacLachlan_mRNA_Conf_2013.pdf.

[No Author Listed], "Messenger RNA", Internet: Wikipedia. Jun. 19, 2013, XP002699196, Retrieved from the Internet: URL: http://en.wikipedia.org/wiki/Messenger RNA.

Archer, S.J., Induction of a T-cell specific antigen on bone marrow lymphocytes with thymus RNA. Immunology. Jan. 1978;34(1):123-9.

Ashley, D.M. et al., Bone marrow-generated dendritic cells pulsed with tumor extracts or tumor RNA induce antitumor immunity against central nervous system tumors. J Exp Med. Oct. 6, 1997;186(7): 1177-82.

Bettinger, T. et al., Peptide-mediated RNA delivery: a novel approach for enhanced transfection of primary and post-mitotic cells. Nucleic Acids Res. Sep. 15, 2001;29(18):3882-91.

Bogers et al., Potent immune responses in rhesus macaques induced by nonviral delivery of a self-amplifying RNA vaccine expressing HIV type 1 envelope with a cationic nanoemulsion.J Infect Dis. Mar. 15, 2015;211(6):947-55. doi: 10.1093/infdis/jiu522. Epub Sep. 18, 2014.

Bonehill, A., et al., Single-step antigen loading and activation of dendritic cells by mRNA electroporation for the purpose of therapeutic vaccination in melanoma patients. Clin Cancer Res. May 2009; 15(10): 3366-3375.

Conry, R.M. et al., Characterization of a messenger RNA polynucleotide vaccine vector. Cancer Res. Apr. 1, 1995 ;55 (7):1397-1400.

Dahlman, James E. et al., In vivo endothelial siRNA delivery using polymeric nanoparticles with low molecular weight, Nature Nanotechnology, 2014, No vol.#, pp. 1-8.

Diken et al., Current Developments in Actively Personalized Cancer Vaccination with a Focus on RNA as the Drug Format. Prog Tumor Res. 2015;42:44-54. doi: 10.1159/000437184. Epub Sep. 4, 2015. Review.

(56) References Cited

OTHER PUBLICATIONS

Fleeton et al., Self-replicative RNA vaccines elicit protection against influenza a virus, respiratory syncytial virus, and a tickborne encephalitis virus. J Infect Dis. May 1, 2001;183(9):1395-8. Epub Mar. 30, 2001.
Geall et al., Nonviral delivery of self-amplifying RNA vaccines. Proc Natl Acad Sci U S A. Sep. 4, 2012;109(36):14604-9. doi:10.1073/pnas.1209367109. Epub Aug. 20, 2012.
Gilboa, E. et al., Cancer immunotherapy with mRNA-transfected dendritic cells. Immunol Rev. Jun. 2004;199:251-63.
Hecker et al., Non-Viral DNA and mRNA Gene Delivery to the CNS Pre-Operatively for Neuroprotection and Following Neurotrauma. Molecular Therapy. 2004; 9, S258-S258.
Heiser, A. et al., Induction of polyclonal prostate cancer-specific CTL using dendritic cells transfected with amplified tumor RNA. J Immunol. Mar. 1, 2001; 166(5):2953-60.
Hoerr, I. et al., In vivo application of RNA leads to induction of specific cytotoxic T lymphocytes and antibodies. EurJ Immunol. Jan. 2000;30(1):1-7.
Hoerr, I. et al., Stabilized Messenger RNA (RNActiveTM) as a Tool for Innovative Gene Delivery. Tissue Engineering. Apr. 2007; 13(4): 865-925.
Hoerr, More than a messenger: A new class of drugs-mRNA-based therapeutics. Genetic Engineering & Biotechnology News. Jun. 18, 2013. http://www.genengnews.com/gen-articles/more-than-a-messenger-a-new-class-of-drugs-mrna-based-therapeutics/4916/ [last accessed Mar. 25, 2016].
Holtkamp, S. et al., Modification of antigen-encoding RNA increases stability, translational efficacy, and T-cell stimulatory capacity of dendritic cells. Blood. Dec. 15, 2006;108(13):4009-17.
Jirikowski, G.F., et al., Reversal of diabetes insipidus in Brattleboro Rats: Intrahypothalamic injection of vasopressin mRNA. Science. Feb. 1992; 255(5047):996-998.
Kallen et al., A development that may evolve into a revolution in medicine: mRNA as the basis for novel, nucleotide-based vaccines and drugs. Ther Adv Vaccines. Jan. 2014;2(1):10-31. doi: 10.1177/2051013613508729.
Kallen et al., A novel, disruptive vaccination technology: self-adjuvanted RNActive(®) vaccines. Hum Vaccin Immunother. Oct. 2013;9(10):2263-76. doi: 10.4161/hv.25181. Epub Jun. 4, 2013. Review.
Kanapathipillai, et al., Nanoparticle targeting of anti-cancer drugs that alter intracellular signaling or influence the tumor microenvironment, Adv. Drug Deliv. Rev. (2014), , pp. 1-12.
Kariko, K., et al., Generating the optimal mRNA for therapy: HPLC purification eliminates immune activation and improves translation of nucleoside-modified, protein-encoding mRNA, Nucleic Acids Research, Oxford University Press, GB, vol. 39, No. 21, Sep. 2, 2011 (Sep. 2, 2011), e142. doi: 10.1093/nar/gkr695. Epub Sep. 2, 2011.
Kisich et al., Antimycobacterial agent based on mRNA encoding human beta-defensin 2 enables primary macrophages to restrict growth of Mycobacterium tuberculosis. Infect Immun. Apr. 2001;69(4):2692-9.
Kozielski, Kristen L. et al., Bioreducible Cationic Polymer-Based Nanoparticles for Efficient and Environmentally Triggered Cytoplasmic siRNA Delivery to Primary Human Brain Cancer Cells, ACS Nano, 2014, vol. 8,' No. 4 ',pp. 3232-3241.
Kreiter, S., et al., Intranodal vaccination with naked antigen-encoding RNA elicits potent prophylactic and therapeutic antitumoral immunity. Cancer Res. 2010; 70: 9031-9040.
Kreiter, S., et al., Tumor vaccination using messenger RNA: prospects of a future therapy. Curr Opinion in Immun. Jun. 2011; 23(3): 399-406.
Kuhn, A.N., et al., mRNA as a versatile tool for exogenous protein expression. Current Gene Therapy. Oct. 2012; 12 (5): 347-361.
Leitner, W.W. et al., DNA and RNA-based vaccines: principles, progress and prospects. Vaccine. Dec. 10, 1999;18 (9-10):765-77.

Li, L. et al., Overcoming obstacles to develop effective and safe siRNA therapeutics. Expert Opin Biol Ther. May 2009; 9(5): 609-19.
Lorenzi, J.C., et al., Intranasal vaccination with messenger RNA as a new approach in gene therapy: Use against tuberculosis. BMC Biotechnol. Oct. 2010; 10(77): 1-11.
Mackey et al., mRNA-based cancer vaccine: prevention of B16 melanoma progression and metastasis by systemic injection of MART1 mRNA histidylated lipopolyplexes, Cancer Gene Therapy, 2007, 14, pp. 802-814.
Magini et al., Self-Amplifying mRNA Vaccines Expressing Multiple Conserved Influenza Antigens Confer Protection against Homologous and Heterosubtypic Viral Challenge. PLoS One. Aug. 15, 2016;11(8):e0161193. doi: 10.1371/journal.pone.0161193. eCollection 2016.
Martinon, F. et al., Induction of virus-specific cytotoxic T lymphocytes in vivo by liposome-entrapped mRNA. EurJ Immunol. Jul. 1993;23(7):1719-22.
Midoux et al., Lipid-based mRNA vaccine delivery systems. Expert Rev Vaccines. Feb. 2015;14(2):221-34. doi: 10.1586/14760584.2015.986104. Epub Dec. 26, 2014. Review.
Mitchell, DA et al., RNA transfected dendritic cells as cancer vaccines. Curr Opin Mal Ther. Apr. 2000;2(2):176-81.
Mitchell, DA et al., RNA-transfected dendritic cells in cancer immunotherapy. J Clin Invest. Nov. 2000;106 (9):1065-9.
Muller, M.R. et al., Transfection of dendritic cells with RNA induces CD4- and COB-mediated T cell immunity against breast carcinomas and reveals the immunodominance of presented T cell epitopes. J Immunol. Jun. 15, 2003;170 (12):5892-6.
Petsch et al., Protective efficacy of in vitro synthesized, specific mRNA vaccines against influenza a virus infection. Nat Biotechnol. Dec. 2012;30(12):1210-6. doi: 10.1038/nbt.2436. Epub Nov. 25, 2012.
Phua et al., Messenger RNA (mRNA) nanoparticle tumour vaccination. Nanoscale. Jul. 21, 2014;6(14):7715-29. doi: 10.1039/c4nr01346h. Review.
Pulford, B., et al., Liposome-siRNA-peptide complexes cross the blood-brain barrier and significantly decrease PrP'C on neuronal cells and PrP'RES in infected cell cultures. PLoS One. 201 O; 5(6): e11085.
Rabinovich, P.M., et al., Synthetic messenger RNA as a tool for gene therapy. Hum. Gene Ther. Oct. 2006; 17: 1027-1035.
Rittig et al., Intradermal vaccinations with RNA coding for TAA generate CD8+ and CD4+ immune responses and induce clinical benefit in vaccinated patients. Mol Ther. May 2011;19(5):990-9. doi: 10.1038/mt.2010.289. Epub Dec. 28, 2010.
Schmitt, W.E. et al., In vitro induction of a bladder cancer-specific T-cell response by mRNA-transfected dendritic cells. J Cancer Res Clin Oncol. 2001 ;127(3):203-6.
Schott, J.W., et al., Viral and non-viral approaches for transient delivery of mRNA and proteins. Current Gene Ther. 2011; 11 (5): 382-398.
Segura, J., et al., Monitoring gene therapy by external imaging of mRNA: Pilot study on murine erythropoietin. Ther Drug Monit. Oct. 2007; 29(5): 612-8.
Smits, E., et al., RNA-based gene transfer for adult stem cells and T cells. Leukemia. 2004; 18: 1898-1902.
Sohn, R.L., et al., In-vivo particle mediated delivery of mRNA to mammalian tissues: ballistic and biological effects. Wound Rep and Regen. Jul.-Aug. 2001; 287-296.
Strong, V.T. et al., Incorporation of beta-globin untranslated regions into a Sindbis virus vector for augmentation of heterologous mRNA expression. Gene Ther. Jun. 1997;4(6):624-7.
Sullenger, BA et al., Emerging clinical applications of RNA. Nature. Jul. 11, 2011;418(6894):252-8.
Tavernier, G., et al., mRNA as gene therapeutic: How to control protein expression. J. of Controlled Release. Mar. 2011; 150(3): 238-247.
Teufel, R. et al., Human peripheral blood mononuclear cells transfected with messenger RNA stimulate antigen-specific cytotoxic T-lymphocytes in vitro. Cell Mol Life Sci. Aug. 2005;62(15):1755-62.

(56) References Cited

OTHER PUBLICATIONS

Thess et al., Sequence-engineered mRNA Without Chemical Nucleoside Modifications Enables an Effective Protein Therapy in Large Animals. Mol Ther. Sep. 2015;23(9):1456-64. doi: 10.1038/mt.2015.103. Epub Jun. 8, 2015.
Wang et al., Systemic delivery of modified mRNA encoding herpes simplex virus 1 thymidine kinase for targeted cancer gene therapy. Mol Ther. Feb. 2013;21(2):358-67. doi: 10.1038/mt.2012.250. Epub Dec. 11, 2012.
Wong et al., An mRNA vaccine for influenza. Nat Biotechnol. Dec. 2012;30(12):1202-4. doi: 10.1038/nbt.2439.
Yamamoto et al., Current prospects for mRNA gene delivery, European Journal of Pharmaceutics and Biopharmaceutics 71 (2009) 484-489.
Zhou, W.Z. et al., RNA melanoma vaccine: induction of antitumor immunity by human glycoprotein 100 mRNA immunization. Hum Gene Ther. Nov. 1, 1999;10(16):2719-24.
U.S. Appl. No. 15/239,613, filed Aug. 17, 2016, Laska et al.
U.S. Appl. No. 15/089,050, filed Apr. 1, 2016, Ciaramella et al.
U.S. Appl. No. 15/748,773, filed Jan. 30, 2018, Ciaramella et al.
U.S. Appl. No. 15/155,986, filed May 16, 2016, Fritz.
U.S. Appl. No. 15/753,293, filed Feb. 17, 2018, Smith.
U.S. Appl. No. 15/753,297, filed Feb. 17, 2018, Thompson.
U.S. Appl. No. 15/748,782, filed Jan. 30, 2018, Mousavi et al.
U.S. Appl. No. 15/156,249, filed May 16, 2016, Miracco.
U.S. Appl. No. 15/767,587, filed Apr. 11, 2018, Ciaramella.
U.S. Appl. No. 15/674,569, filed Aug. 11, 2017, Ciaramella et al.
U.S. Appl. No. 15/767,600, filed Apr. 11, 2018, Ciaramella et al.
U.S. Appl. No. 15/769,710, filed Apr. 19, 2018, Ciaramella et al.
U.S. Appl. No. 15/767,609, filed Apr. 11, 2018, Ciaramella et al.
U.S. Appl. No. 15/767,613, filed Apr. 11, 2018, Ciaramella et al.
U.S. Appl. No. 15/767,618, filed Apr. 11, 2018, Ciaramella et al.
U.S. Appl. No. 15/674,591, filed Aug. 11, 2017, Ciaramella et al.
U.S. Appl. No. 15/746,286, filed Jan. 19, 2018, Ciaramella et al.
U.S. Appl. No. 15/266,791, filed Sep. 15, 2016, Bancel et al.
U.S. Appl. No. 15/905,576, filed Feb. 26, 2018, Bancel et al.
U.S. Appl. No. 15/387,263, filed Dec. 21, 2016, Chen et al.
U.S. Appl. No. 15/674,107, filed Aug. 10, 2017, Besin et al.
U.S. Appl. No. 15/674,872, filed Aug. 11, 2017, Besin et al.
U.S. Appl. No. 14/364,187, filed Jun. 10, 2014, Bancel.
U.S. Appl. No. 15/698,285, filed Sep. 7, 2017, Wang et al.
U.S. Appl. No. 15/674,599, filed Aug. 11, 2017, Ciaramella et al.
U.S. Appl. No. 15/880,436, filed Jan. 25, 2018, Ciaramella.
PCT/US2016/058324, dated May 3, 2018, International Preliminary Report on Patentability.
Richner et al., Modified mRNA Vaccines Protect against Zika Virus Infection. Cell. Mar. 23, 2017;169(1):176. doi: 10.1016/j.cell.2017.03.016.
Parisien et al., Rationalization and prediction of selective decoding of pseudouridine-modified nonsense and sense codons. RNA. Mar. 2012;18(3):355-67. doi: 10.1261/rna.031351.111. Epub Jan. 26, 2012.

* cited by examiner

JEV mRNA vaccine immunogenicity Balb/c

Fig. 4

ICS of Zika prME transfected cells

(Bar chart: Mean Fluorescent intensity vs samples: Sec only, Untransfected + Serum + Sec, S02-1:20, S46-1:20)

Fig. 5

(Western blot image)

kDa — 188, 98, 62, 49, 38, 28, 17, 14, 6

Lanes:
1. Unpurified VLP Sup - PEG
2. Untransfected Sup - PEG
3. Ultracentrifuge purified VLP

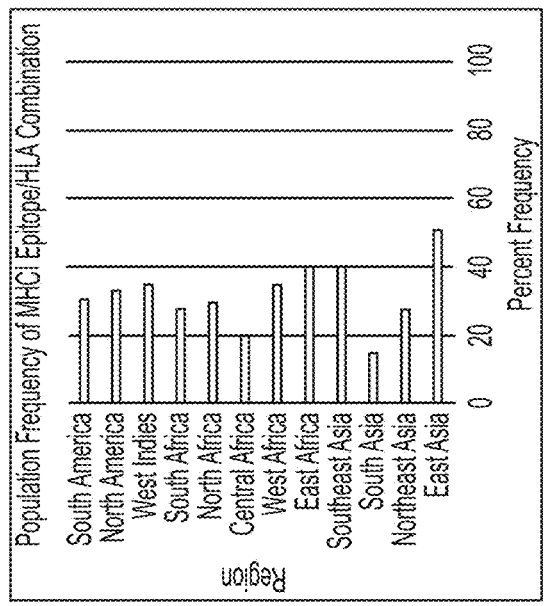
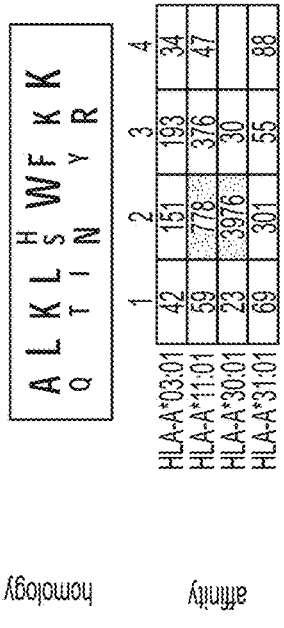
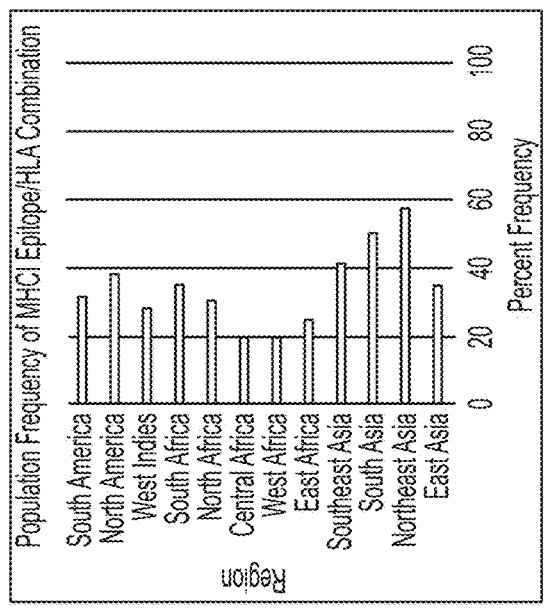
Fig. 8C

Fig. 12
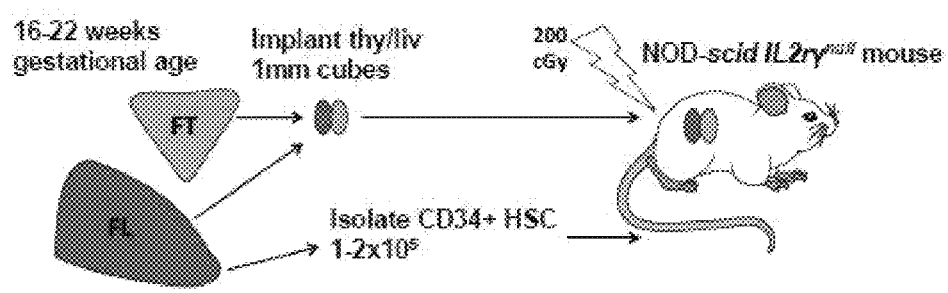
Human CD8 T cells stimulated with peptide epitope
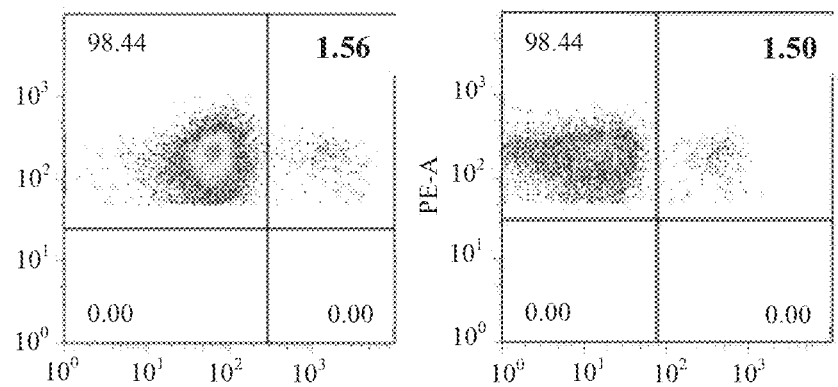

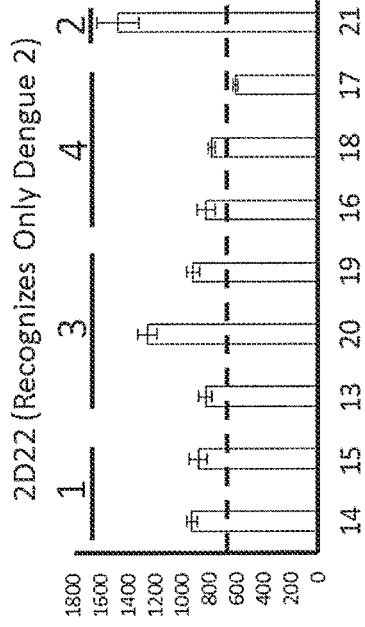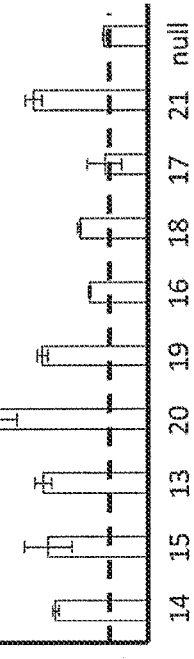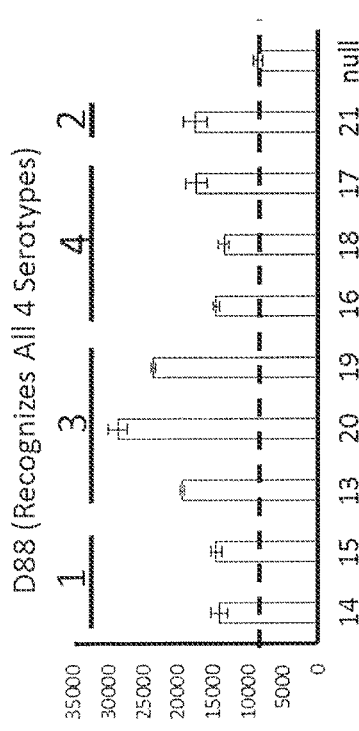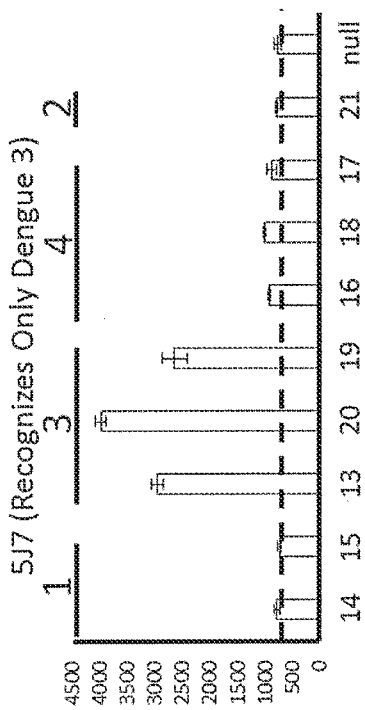
Fig. 16

Fig. 19I

Health Score– Groups 13-19

- prME Combo + H2Kb Multitope 10ug (Post7)
- prME Combo + non-H2Kb Multitope 10ug (Post7)
- prME Comb 8ug (Post7)
- prME Combo + H2Kb Multitope 10ug (Post1)
- prME Combo + non-H2Kb Multitope 10ug (Post1)
- prME Combo 8ug (Post1)
- Naïve

Fig. 20

HeLa Lysate
CHIKV-E: Construct1, Construct2, Construct3, PBS

CHIKV-E protein (~60 kDa), shown in Construct2 lane.

Three mRNA constructs encoded CHIKV envelope protein design and tested

Groups 1-4, 7-9 Day 56 Challenge

Groups 10-16 Day 112 challenge

Fig. 30A

**BS-1954r4 Groups 1-4, 7-9 Day 28
Antibody titers against CHIKV E1**

Fig. 30B

**BS-1954r4 Groups 1-4, 7-9 Day 28
Antibody titers against CHIKV E2**

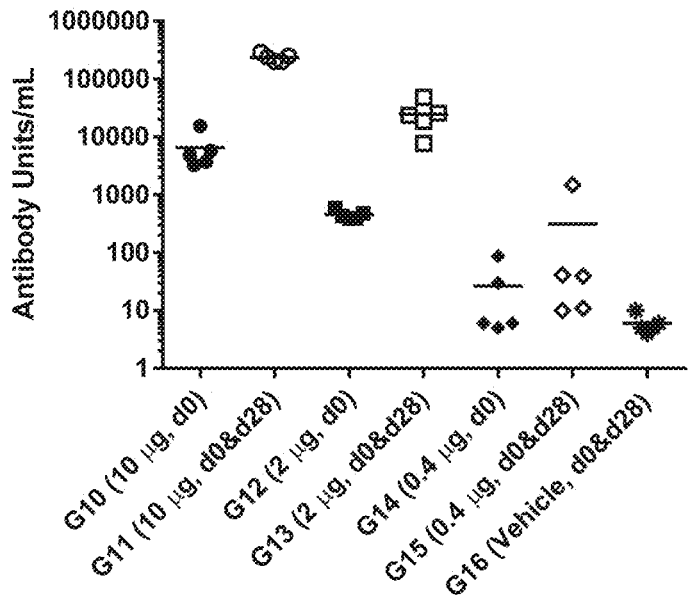
Fig. 32C
BS-1954r4 Groups 10-16 Day 56
Antibody titers against CHIKV lysate
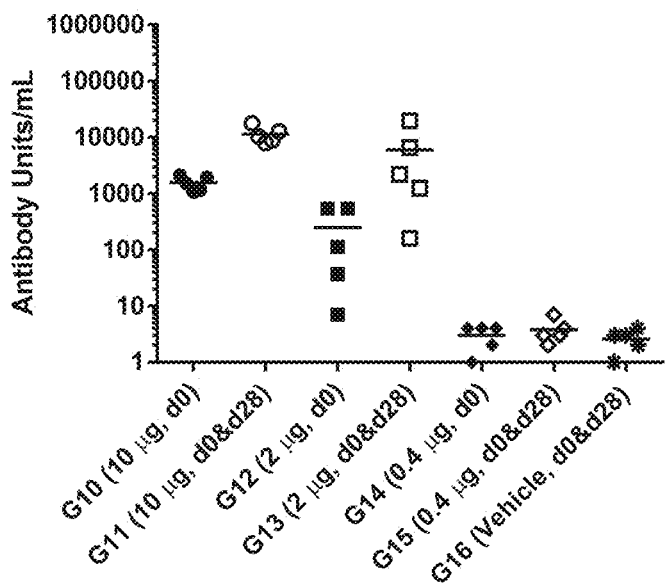
F Fig. 33B
BS-1954r4 Groups 10-16 Day 112
Antibody titers against CHIKV E2

Fig. 33C
BS-1954r4 Groups 10-16 Day 112
Antibody titers against CHIKV lysate

Fig. 34
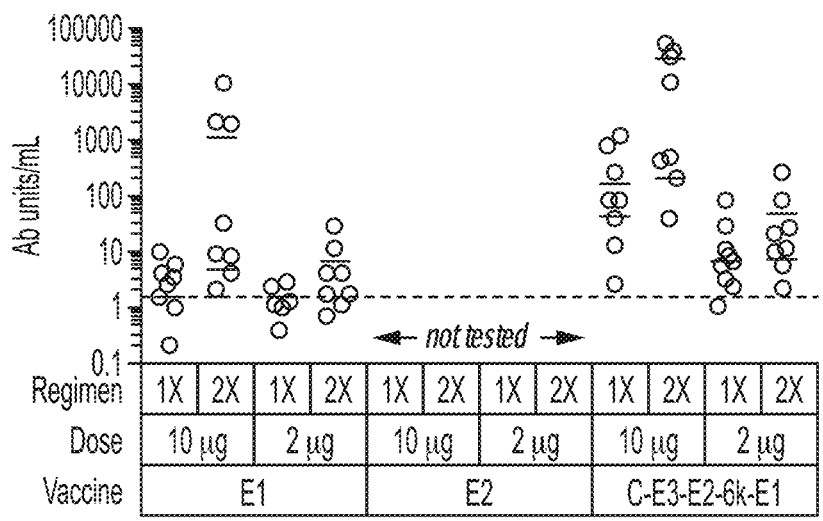
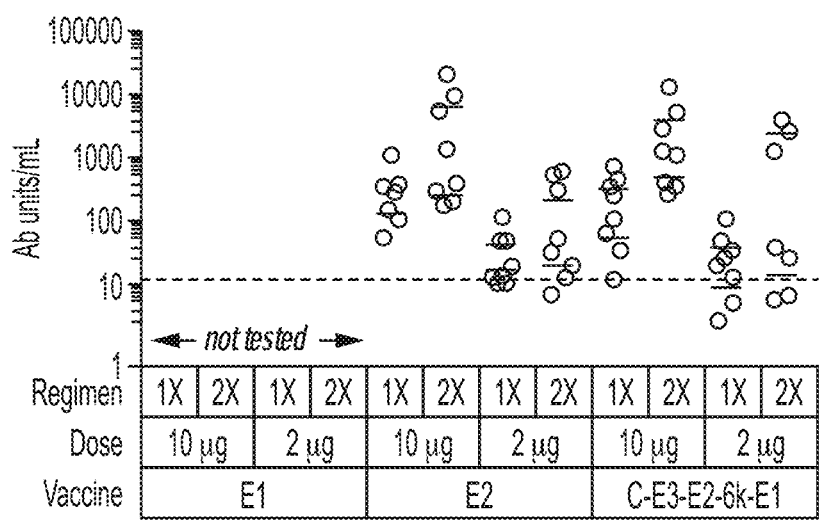
1X dosed day 0, 2X dosed days 0 and 28
Dotted horizontal line represents response in naive control Fig. 35
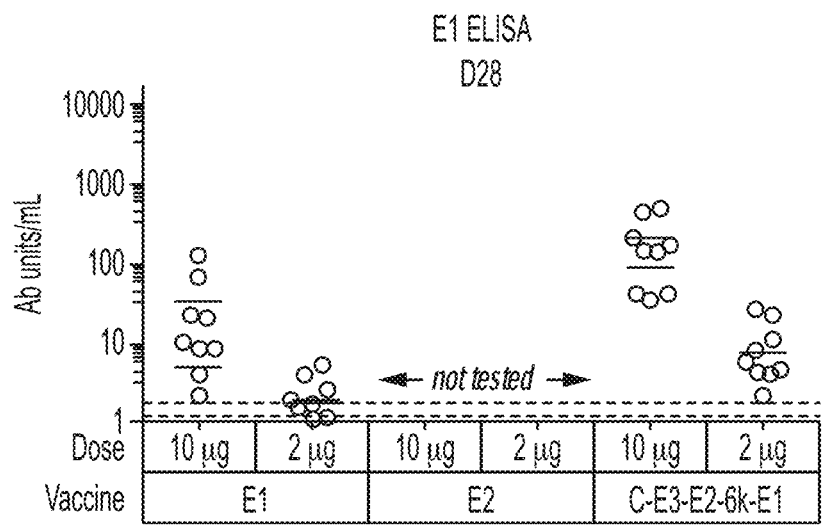
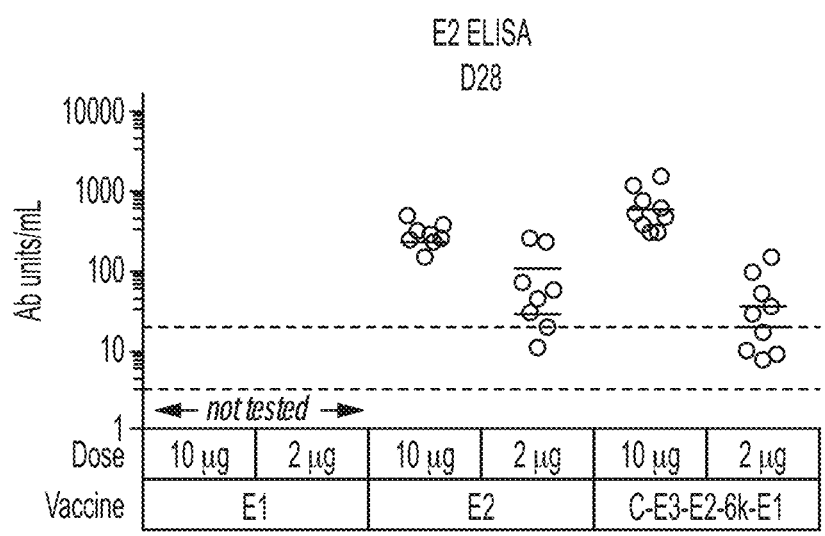
Similar Ab responses in the 2 strains of mice (28 days after 1 immunization)
Dotted horizontal line represents response in naive control

Fig. 40 mRNA encoding CHIKV pp induces broadly neutralizing antibody

Wild-type strain A129 mice, day 56 sera 1X dosed day 0
2X dosed days 0 and 28

CHIKV strain 37997 (Africa-Senegal)

CHIKV strain La Reunion

CHIKV strain CDC CAR

Fig. 46

Binding Ab titers against CHIKV lysate

(graph showing CHIK lysate antibody titer (unit/ml) vs Day-1, Day 28, Day 56, Day 84; arrows indicate 1st dose, 2nd dose, 3rd dose)

—○— 75ug- VAL-181388
—□— 25ug- VAL-181388-
—△— 75ug- NTIX unspecific

Neutralizing titer against 37997 CHIKV

(graph showing CHIKV PRNT 50% vs Day-1, Day 28, Day 56, Day 84; arrows indicate 1st dose, 2nd dose, 3rd dose)

ZIKA VIRUS RNA VACCINES

RELATED APPLICATIONS

This application is a continuation of international application number PCT/US2016/058324, which claims the benefit under 35 U.S.C. § 119(e) of U.S. provisional application No. 62/244,937, filed Oct. 22, 2015, U.S. provisional application number 62/247,347, filed Oct. 28, 2015, U.S. provisional application No. 62/244,814, filed Oct. 22, 2015, U.S. provisional application No. 62/247,390, filed Oct. 28, 2015, U.S. provisional application No. 62/245,207, filed Oct. 22, 2015, U.S. provisional application No. 62/247,445, filed Oct. 28, 2015, U.S. provisional application No. 62/244,950, filed Oct. 22, 2015, U.S. provisional application No. 62/247,595, filed Oct. 28, 2015, U.S. provisional application No. 62/351,255, filed Jun. 16, 2016 and U.S. provisional application No. 62/245,031, filed Oct. 22, 2015, each of which is incorporated by reference herein in its entirety.

BACKGROUND

Insects such as mosquitoes cause significant human suffering by transmission of infectious disease to humans. The infections carried by mosquitoes afflict humans, as well as companion animals such as dogs and horses. Infectious agents transmitted by mosquitos cause illnesses such as encephalitis, Chikungunya, yellow fever, West Nile fever, malaria, and Dengue. The transmission of diseases associated with mosquito bites can be interrupted by killing the mosquitoes, isolating infected people from all mosquitoes while they are infectious or vaccinating the exposed population.

Deoxyribonucleic acid (DNA) vaccination is one technique used to stimulate humoral and cellular immune responses to foreign antigens, such as Malaria, JEV, WNV, EEEV, VEEV, SINV, CHIKV, DENV, ZIKV and YFV antigens. The direct injection of genetically engineered DNA (e.g., naked plasmid DNA) into a living host results in a small number of its cells directly producing an antigen, resulting in a protective immunological response. With this technique, however, comes potential problems, including the possibility of insertional mutagenesis, which could lead to the activation of oncogenes or the inhibition of tumor suppressor genes.

SUMMARY

Provided herein are ribonucleic acid (RNA) vaccines that build on the knowledge that RNA (e.g., messenger RNA (mRNA)) can safely direct the body's cellular machinery to produce nearly any protein of interest, from native proteins to antibodies and other entirely novel protein constructs that can have therapeutic activity inside and outside of cells. The RNA (e.g., mRNA) vaccines of the present disclosure may be used to induce a balanced immune response against Malaria (e.g., P. falciparum, P. vivax, P. Malariae and/or P. ovale), Japanese Encephalitis Virus (JEV), West Nile Virus (WNV), Eastern Equine Encephalitis Virus (EEEV), Venezuelan Equine Encephalitis Virus (VEEV), Sindbis Virus (SINV), Chikungunya Virus (CHIKV), Dengue Virus (DENV), Zika Virus (ZIKV) and/or Yellow Fever Virus (YFV), comprising both cellular and humoral immunity, without risking the possibility of insertional mutagenesis, for example. Malaria (e.g., P. falciparum, P. vivax, P. Malariae and/or P. ovale), JEV, WNV, EEEV, VEEV, SINV, CHIKV, DENV, ZIKV and/or YFV are referred to herein as "tropical diseases." Thus, the terms "tropical disease vaccines" and "Malaria (e.g., P. falciparum, P. vivax, P. Malariae and/or P. ovale), JEV, WNV, EEEV, VEEV, SINV, CHIKV, DENV, ZIKV and/or YFV" encompass Malaria (e.g., P. falciparum, P. vivax, P. Malariae and/or P. ovale) RNA vaccines, JEV RNA vaccines, WNV RNA vaccines, EEEV RNA vaccines, SINV RNA vaccines, CHIKV RNA vaccines, DENV RNA vaccines, ZIKV RNA vaccines, YFV RNA vaccines, and combination vaccines comprising at least two (e.g., at least 3, 4, 5, 6, 7, 8 or 9) of any of the Malaria (e.g., P. falciparum, P. vivax, P. Malariae and/or P. ovale) RNA vaccines, JEV RNA vaccines, WNV RNA vaccines, EEEV RNA vaccines, SINV RNA vaccines, CHIKV RNA vaccines, DENV RNA vaccines, ZIKV RNA vaccines, and YFV RNA vaccines.

The RNA (e.g., mRNA) vaccines may be utilized in various settings depending on the prevalence of the infection or the degree or level of unmet medical need. The RNA (e.g. mRNA) vaccines may be utilized to treat and/or prevent Malaria (e.g., P. falciparum, P. vivax, P. Malariae and/or P. ovale), JEV, WNV, EEEV, VEEV, SINV, CHIKV, DENV, ZIKV and/or YFV of various genotypes, strains, and isolates. The RNA (e.g., mRNA) vaccines have superior properties in that they produce much larger antibody titers and responses earlier than commercially available anti-viral therapeutic treatments. While not wishing to be bound by theory, it is believed that the RNA (e.g., mRNA) vaccines, as mRNA polynucleotides, are better designed to produce the appropriate protein conformation upon translation, as the RNA (e.g., mRNA) vaccines co-opt natural cellular machinery. Unlike traditional vaccines, which are manufactured ex vivo and may trigger unwanted cellular responses, RNA (e.g., mRNA) vaccines are presented to the cellular system in a more native fashion.

Surprisingly, it has been shown that efficacy of mRNA vaccines can be significantly enhanced when combined with a flagellin adjuvant, in particular, when one or more antigen-encoding mRNA is combined with an mRNA encoding flagellin. RNA (e.g., mRNA) vaccines combined with the flagellin adjuvant (e.g., mRNA-encoded flagellin adjuvant) have superior properties in that they may produce much larger antibody titers and produce responses earlier than commercially available vaccine formulations.

Some embodiments of the present disclosure provide RNA (e.g., mRNA) vaccines that include at least one RNA (e.g., mRNA) polynucleotide having an open reading frame encoding at least one antigenic polypeptide or an immunogenic fragment thereof (e.g., an immunogenic fragment capable of inducing an immune response to the antigenic polypeptide) and at least one RNA (e.g., mRNA polynucleotide) having an open reading frame encoding a flagellin adjuvant.

In some embodiments, at least one flagellin polypeptide (e.g., encoded flagellin polypeptide) is a flagellin protein. In some embodiments, at least one flagellin polypeptide (e.g., encoded flagellin polypeptide) is an immunogenic flagellin fragment. In some embodiments, at least one flagellin polypeptide and at least one antigenic polypeptide are encoded by a single RNA (e.g., mRNA) polynucleotide. In other embodiments, at least one flagellin polypeptide and at least one antigenic polypeptide are each encoded by a different RNA polynucleotide.

In some embodiments at least one flagellin polypeptide has at least 80%, at least 85%, at least 90%, or at least 95% identity to a flagellin polypeptide having a sequence of SEQ ID NO: 420-422.

Provided herein, in some embodiments, is a ribonucleic acid (RNA) (e.g., mRNA) vaccine, comprising at least one (e.g., at least 2, 3, 4 or 5) RNA (e.g., mRNA) polynucleotide having an open reading frame encoding at least one (e.g., at least 2, 3, 4 or 5) Malaria (e.g., *P. falciparum, P. vivax, P. Malariae* and/or *P. ovale*), JEV, WNV, EEEV, VEEV, SINV, CHIKV, DENV, ZIKV and/or YFV antigenic polypeptide, or any combination of two or more of the foregoing antigenic polypeptides. Herein, use of the term "antigenic polypeptide" encompasses immunogenic fragments of the antigenic polypeptide (an immunogenic fragment that induces (or is capable of inducing) an immune response to Malaria (e.g., *P. falciparum, P. vivax, P. Malariae* and/or *P. ovale*), JEV, WNV, EEEV, VEEV, SINV, CHIKV, DENV, ZIKV and/or YFV) unless otherwise stated.

Also provided herein, in some embodiments, is a RNA (e.g., mRNA) vaccine comprising at least one (e.g., at least 2, 3, 4 or 5) RNA polynucleotide having an open reading frame encoding at least one (e.g., at least 2, 3, 4 or 5) Malaria (e.g., *P. falciparum, P. vivax, P. Malariae* and/or *P. ovale*), JEV, WNV, EEEV, VEEV, SINV, CHIKV, DENV, ZIKV and/or YFV antigenic polypeptide or an immunogenic fragment thereof, linked to a signal peptide.

Further provided herein, in some embodiments, is a nucleic acid (e.g., DNA) encoding at least one (e.g., at least 2, 3, 4 or 5) Malaria (e.g., *P. falciparum, P. vivax, P. Malariae* and/or *P. ovale*), JEV, WNV, EEEV, VEEV, SINV, CHIKV, DENV, ZIKV and/or YFV RNA (e.g., mRNA) polynucleotide.

Further still, provided herein, in some embodiments, is a method of inducing an immune response in a subject, the method comprising administering to the subject a vaccine comprising at least one (e.g., at least 2, 3, 4 or 5) RNA (e.g., mRNA) polynucleotide having an open reading frame encoding at least one (e.g., at least 2, 3, 4 or 5) Malaria (e.g., *P. falciparum, P. vivax, P. Malariae* and/or *P. ovale*), JEV, WNV, EEEV, VEEV, SINV, CHIKV, DENV, ZIKV and/or YFV antigenic polypeptide, or any combination of two or more of the foregoing antigenic polypeptides.

Malaria

Some embodiments of the present disclosure provide Malaria vaccines that include at least one ribonucleic acid (RNA) polynucleotide having an open reading frame encoding at least one *Plasmodium* (e.g., *P. falciparum, P. vivax, P. Malariae* and/or *P. ovale*) antigenic polypeptide or an immunogenic fragment thereof (e.g., an immunogenic fragment capable of raising an immune response to *Plasmodium*).

In some embodiments, the antigenic polypeptide is a circumsporozoite (CS) protein or an immunogenic fragment thereof (e.g., capable of raising an immune response against *Plasmodium*).

In some embodiments, the CS protein or fragment is fused to the surface antigen from hepatitis B (HBsAg). In some embodiments, the CS protein or fragment is in the form of a hybrid protein comprising substantially all the C-terminal portion of the CS protein of *Plasmodium*, four or more tandem repeats of the CS protein immunodominant region, and the surface antigen from hepatitis B (HBsAg). In some embodiments, the hybrid protein comprises a sequence of CS protein of *Plasmodium falciparum* substantially as corresponding to amino acids 207-395 of *P. falciparum* NF54 strain 3D7 clone CS protein fused in frame via a linear linker to the N-terminal of HBsAg (Ballou W R et al. *Am J Trop Med Hyg* 2004; 71(2_suppl):239-247, incorporated herein by reference).

In some embodiments, the hybrid protein is RTS. In some embodiments, the RTS is in the form of mixed particles RTS,S. In some embodiments, the amount of RTS,S is 25 μg or 50 μg per dose.

In some embodiments, the antigenic polypeptide is liver stage antigen 1 (LSA1) or an immunogenic fragment thereof. In some embodiments, the antigenic polypeptide is LSA-NRC.

In some embodiments, the antigenic polypeptide is merozoite surface protein-1 (MSP1) or an immunogenic fragment thereof.

In some embodiments, the antigenic polypeptide is apical membrane antigen 1 (AMA1) or an immunogenic fragment thereof.

In some embodiments, the antigenic polypeptide is thrombospondin related adhesive protein (TRAP) or an immunogenic fragment thereof.

In some embodiments, at least one RNA polynucleotide is encoded by at least one nucleic acid sequence identified by any one of SEQ ID NO: 1-6 (Table 1) and homologs having at least 80% identity with a nucleic acid sequence identified by any one of SEQ ID NO: 1-6 (Table 1). In some embodiments, at least one RNA polynucleotide is encoded by at least one nucleic acid sequence identified by any one of SEQ ID NO: 1-6 (Table 1) and homologs having at least 90% (90%, 91%, 92%, 93%, 94%, 95%, 96%, 97%, 98%, 99%, 99.8% or 99.9%) identity with a nucleic acid sequence identified by any one of SEQ ID NO: 1-6 (Table 1). In some embodiments, at least one RNA polynucleotide is encoded by at least one fragment of a nucleic acid sequence identified by any one of SEQ ID NO: 1-6 (Table 1).

In some embodiments, at least one RNA polynucleotide comprises at least one nucleic acid sequence identified by any one of SEQ ID NO: 7-12 (Table 1) and homologs having at least 80% identity with a nucleic acid sequence identified by any one of SEQ ID NO: 7-12 (Table 1). In some embodiments, at least one RNA polynucleotide comprises at least one nucleic acid sequence identified by any one of SEQ ID NO: 7-12 (Table 1) and homologs having at least 90% (90%, 91%, 92%, 93%, 94%, 95%, 96%, 97%, 98%, 99%, 99.8% or 99.9%) identity with a nucleic acid sequence identified by any one of SEQ ID NO: 7-12 (Table 1). In some embodiments, at least one RNA polynucleotide comprises at least one fragment of a nucleic acid sequence identified by any one of SEQ ID NO: 7-12 (Table 1).

In some embodiments, the at least one RNA polynucleotide encodes at least one antigenic polypeptide having a sequence identified by any one of SEQ ID NO: 13-17 (Table 2 and 3). In some embodiments, the at least one RNA polynucleotide encodes at least one protein variant having at least 95% identity to an antigenic polypeptide having a sequence identified by any one of SEQ ID NO: 13-17 (Table 2 and 3). In some embodiments, at least one antigenic polypeptide has an amino acid sequence identified by any one of SEQ ID NO: 13-17 (Table 2 and 3). In some embodiments, at least one antigenic polypeptide has at least 95% identity to an antigenic polypeptide having a sequence identified by any one of SEQ ID NO: 13-17 (Table 2 and 3).

Japanese Encephalitis Virus (JEV)

Some embodiments of the present disclosure provide JEV vaccines that include at least one ribonucleic acid (RNA) polynucleotide having an open reading frame encoding at least one JEV antigenic polypeptide or an immunogenic fragment thereof (e.g., an immunogenic fragment capable of inducing an immune response to JEV).

In some embodiments, at least one antigenic polypeptide is JEV E protein, JEV Es, JEV prM, JEV capsid, JEV NS1, JEV prM and E polyprotein (prME) or an immunogenic fragment thereof. In some embodiments, at least one antigenic polypeptide has at least 80%, 85%, 90%, 92%, 95%, 96%, 97%, 98% or 99% sequence identity to JEV E protein, JEV Es, JEV prM, JEV capsid, prME or JEV NS1.

In some embodiments, at least one RNA polynucleotide is encoded by at least one nucleic acid sequence identified by any one of SEQ ID NO: 18-19 (Table 4) and homologs having at least 80% identity with a nucleic acid sequence identified by any one of SEQ ID NO: 18-19 (Table 4). In some embodiments, at least one RNA polynucleotide is encoded by at least one nucleic acid sequence identified by any one of SEQ ID NO: 18-19 (Table 4) and homologs having at least 90% (90%, 91%, 92%, 93%, 94%, 95%, 96%, 97%, 98%, 99%, 99.8% or 99.9%) identity with a nucleic acid sequence identified by any one of SEQ ID NO: 18-19 (Table 4). In some embodiments, at least one RNA polynucleotide is encoded by at least one fragment of a nucleic acid sequence identified by any one of SEQ ID NO: 18-19 (Table 4).

In some embodiments, at least one RNA polynucleotide comprises at least one nucleic acid sequence identified by any one of SEQ ID NO: 20-21 (Table 4) and homologs having at least 80% identity with a nucleic acid sequence identified by any one of SEQ ID NO: 20-21 (Table 4). In some embodiments, at least one RNA polynucleotide comprises at least one nucleic acid sequence identified by any one of SEQ ID NO: 20-21 (Table 4) and homologs having at least 90% (90%, 91%, 92%, 93%, 94%, 95%, 96%, 97%, 98%, 99%, 99.8% or 99.9%) identity with a nucleic acid sequence identified by any one of SEQ ID NO: 20-21 (Table 4). In some embodiments, at least one RNA polynucleotide comprises at least one fragment of a nucleic acid sequence identified by any one of SEQ ID NO: 20-21 (Table 4).

In some embodiments, the at least one RNA polynucleotide encodes at least one antigenic polypeptide having a sequence identified by any one of SEQ ID NO: 22-29 (Table 5 and 6). In some embodiments, the at least one RNA polynucleotide encodes at least one protein variant having at least 95% identity to an antigenic polypeptide having a sequence identified by any one of SEQ ID NO: 22-29 (Table 5 and 6). In some embodiments, at least one antigenic polypeptide has an amino acid sequence identified by any one of SEQ ID NO: 22-29 (Table 5 and 6). In some embodiments, at least one antigenic polypeptide has at least 95% identity to an antigenic polypeptide having a sequence identified by any one of SEQ ID NO: 22-29 (Table 5 and 6).

West Nile Virus (WNV), Eastern Equine Encephalitis (EEEV), Venezuelan Equine Encephalitis Virus (VEEV), and Sindbis Virus (SINV)

Some embodiments of the present disclosure provide combination vaccines comprising one or more RNA (e.g., mRNA) polynucleotides. The RNA polynucleotide(s) encode one or more Arbovirus antigens and/or one or more Alphavirus antigens, on either the same polynucleotide or different polynucleotides. RNA polynucleotides featured in the vaccines of the present invention can encode one antigen or can encode more than one antigen, e.g., several antigens (for example, polycistronic RNAs).

In some embodiments, at least one RNA polynucleotide is encoded by at least one nucleic acid sequence identified by any one of SEQ ID NO: 30-34, 48-49, 55-56 (Table 9, 12, 15) and homologs having at least 80% identity with a nucleic acid sequence identified by any one of SEQ ID NO: 30-34, 48-49, 55-56 (Table 9, 12, 15). In some embodiments, at least one RNA polynucleotide is encoded by at least one nucleic acid sequence identified by any one of SEQ ID NO: 30-34, 48-49, 55-56 (Table 9, 12, 15) and homologs having at least 90% (90%, 91%, 92%, 93%, 94%, 95%, 96%, 97%, 98%, 99%, 99.8% or 99.9%) identity with a nucleic acid sequence identified by any one of SEQ ID NO: 30-34, 48-49, 55-56 (Table 9, 12, 15). In some embodiments, at least one RNA polynucleotide is encoded by at least one fragment of a nucleic acid sequence identified by any one of SEQ ID NO: 30-34, 48-49, 55-56 (Table 9, 12, 15).

In some embodiments, at least one RNA polynucleotide comprises at least one nucleic acid sequence identified by any one of SEQ ID NO: 35-39, 50-51, 57-58 (Table 9, 12, 15) and homologs having at least 80% identity with a nucleic acid sequence identified by any one of SEQ ID NO: 35-39, 50-51, 57-58 (Table 9, 12, 15). In some embodiments, at least one RNA polynucleotide comprises at least one nucleic acid sequence identified by any one of SEQ ID NO: 35-39, 50-51, 57-58 (Table 9, 12, 15) and homologs having at least 90% (90%, 91%, 92%, 93%, 94%, 95%, 96%, 97%, 98%, 99%, 99.8% or 99.9%) identity with a nucleic acid sequence identified by any one of SEQ ID NO: 35-39, 50-51, 57-58 (Table 9, 12, 15). In some embodiments, at least one RNA polynucleotide comprises at least one fragment of a nucleic acid sequence identified by any one of SEQ ID NO: 35-39, 50-51, 57-58 (Table 9, 12, 15).

In some embodiments, the at least one RNA polynucleotide encodes at least one antigenic polypeptide having a sequence identified by any one of SEQ ID NO: 44-47, 52-54, 59-64 (Table 10, 11, 13, 14, 16, 17 and 18). In some embodiments, the at least one RNA polynucleotide encodes at least one protein variant having at least 95% identity to an antigenic polypeptide having a sequence identified by any one of SEQ ID NO: 44-47, 52-54, 59-64 (Table 10, 11, 13, 14, 16, 17 and 18). In some embodiments, at least one antigenic polypeptide has an amino acid sequence identified by any one of SEQ ID NO: 44-47, 52-54, 59-64 (Table 10, 11, 13, 14, 16, 17 and 18). In some embodiments, at least one antigenic polypeptide has at least 95% identity to an antigenic polypeptide having a sequence identified by any one of SEQ ID NO: 44-47, 52-54, 59-64 (Table 10, 11, 13, 14, 16, 17 and 18).

Yellow Fever Virus (YFV)

Yellow fever is an acute viral haemorrhagic disease transmitted by infected mosquitoes. The "yellow" in the name refers to the jaundice that affects some patients. Symptoms of yellow fever include fever, headache, jaundice, muscle pain, nausea, vomiting and fatigue. A small proportion of patients who contract the virus develop severe symptoms and approximately half of those die within 7 to 10 days. Yellow fever virus (YFV) is endemic in tropical areas of Africa and Central and South America. Large epidemics of yellow fever occur when infected people introduce the virus into heavily populated areas with high mosquito density and where most people have little or no immunity, due to lack of vaccination. In these conditions, infected mosquitoes transmit the virus from person to person. Since the launch of the Yellow Fever Initiative in 2006, significant progress in combating the disease has been made in West Africa and more than 105 million people have been vaccinated in mass campaigns using an attenuated live vaccine. Nonetheless, this vaccine can cause yellow fever vaccine-associated viscerotropic disease as well as yellow fever vaccine-associated neurotropic disease, each of which can be fatal.

Some embodiments of the present disclosure provide Yellow fever virus (YFV) vaccines that include at least one ribonucleic acid (RNA) polynucleotide (e.g., mRNA polynucleotide) having an open reading frame encoding at least one YFV antigenic polypeptide or an immunogenic fragment thereof (e.g., an immunogenic fragment capable of inducing an immune response to YFV).

In some embodiments, the at least one antigenic polypeptide is a YFV polyprotein.

In some embodiments, the at least one antigenic polypeptide is a YFV capsid protein, a YFV premembrane/membrane protein, a YFV envelope protein, a YFV non-structural protein 1, a YFV non-structural protein 2A, a YFV non-structural protein 2B, a YFV non-structural protein 3, a YFV non-structural protein 4A, a YFV non-structural protein 4B, or a YFV non-structural protein 5.

In some embodiments, the at least one antigenic polypeptide is a YFV capsid protein or an immunogenic fragment thereof, a YFV premembrane/membrane protein or an immunogenic fragment thereof, and a YFV envelope protein or an immunogenic fragment thereof.

In some embodiments, the at least one antigenic polypeptide is a YFV capsid protein or an immunogenic fragment thereof and a YFV premembrane/membrane protein or an immunogenic fragment thereof.

In some embodiments, the at least one antigenic polypeptide is a YFV capsid protein or an immunogenic fragment thereof and a YFV envelope protein or an immunogenic fragment thereof.

In some embodiments, at least one antigenic polypeptide is a YFV premembrane/membrane protein or an immunogenic fragment thereof and a YFV envelope protein or an immunogenic fragment thereof.

In some embodiments, the at least one antigenic polypeptide further comprises any one or more of a YFV non-structural protein 1, 2A, 2B, 3, 4A, 4B or 5.

In some embodiments, at least one RNA polynucleotide is encoded by at least one nucleic acid sequence identified by any one of SEQ ID NO: 65-80 (Table 21) and homologs having at least 80% identity with a nucleic acid sequence identified by any one of SEQ ID NO: 65-80 (Table 21). In some embodiments, at least one RNA polynucleotide is encoded by at least one nucleic acid sequence identified by any one of SEQ ID NO: 65-80 (Table 21) and homologs having at least 90% (90%, 91%, 92%, 93%, 94%, 95%, 96%, 97%, 98%, 99%, 99.8% or 99.9%) identity with a nucleic acid sequence identified by any one of SEQ ID NO: 65-80 (Table 21). In some embodiments, at least one RNA polynucleotide is encoded by at least one fragment of a nucleic acid sequence identified by any one of SEQ ID NO: 65-80 (Table 21).

In some embodiments, at least one RNA polynucleotide comprises at least one nucleic acid sequence identified by any one of SEQ ID NO: 81-96 (Table 21) and homologs having at least 80% identity with a nucleic acid sequence identified by any one of SEQ ID NO: 81-96 (Table 21). In some embodiments, at least one RNA polynucleotide comprises at least one nucleic acid sequence identified by any one of SEQ ID NO: 81-96 (Table 21) and homologs having at least 90% (90%, 91%, 92%, 93%, 94%, 95%, 96%, 97%, 98%, 99%, 99.8% or 99.9%) identity with a nucleic acid sequence identified by any one of SEQ ID NO: 81-96 (Table 21). In some embodiments, at least one RNA polynucleotide comprises at least one fragment of a nucleic acid sequence identified by any one of SEQ ID NO: 81-96 (Table 21).

In some embodiments, the at least one RNA polynucleotide encodes at least one antigenic polypeptide having a sequence identified by any one of SEQ ID NO: 97-117 (Table 22). In some embodiments, at least one RNA polynucleotide encodes at least one protein variant having at least 95% identity to an antigenic polypeptide having a sequence identified by any one of SEQ ID NO: 97-117 (Table 22). In some embodiments, at least one antigenic polypeptide has an amino acid sequence identified by any one of SEQ ID NO: 97-117 (Table 22). In some embodiments, at least one antigenic polypeptide has at least 95% identity to an antigenic polypeptide having a sequence identified by any one of SEQ ID NO: 97-117 (Table 22).

Zika Virus (ZIKV)

Zika virus (ZIKV) is a member of the Flaviviridae virus family and the *flavivirus* genus. In humans, it causes a disease known as Zika fever. It is related to dengue, yellow fever, West Nile and Japanese encephalitis, viruses that are also members of the virus family Flaviviridae. ZIKV is spread to people through mosquito bites. The most common symptoms of ZIKV disease (Zika) are fever, rash, joint pain, and red eye. The illness is usually mild with symptoms lasting from several days to a week. There is no vaccine to prevent, or medicine to treat, Zika virus.

Some embodiments of the present disclosure provide Zika virus (ZIKV) vaccines that include at least one ribonucleic acid (RNA) polynucleotide (e.g., mRNA polynucleotide) having an open reading frame encoding at least one ZIKV antigenic polypeptide or an immunogenic fragment thereof (e.g., an immunogenic fragment capable of inducing an immune response to ZIKV).

In some embodiments, at least one antigenic polypeptide is a ZIKV polyprotein. In some embodiments, at least one antigenic polypeptide is a ZIKV structural polyprotein. In some embodiments, at least one antigenic polypeptide is a ZIKV nonstructural polyprotein.

In some embodiments, at least one antigenic polypeptide is a ZIKV capsid protein, a ZIKV premembrane/membrane protein, a ZIKV envelope protein, a ZIKV non-structural protein 1, a ZIKV non-structural protein 2A, a ZIKV non-structural protein 2B, a ZIKV non-structural protein 3, a ZIKV non-structural protein 4A, a ZIKV non-structural protein 4B, or a ZIKV non-structural protein 5.

In some embodiments, at least one antigenic polypeptide is a ZIKV capsid protein, a ZIKV premembrane/membrane protein, a ZIKV envelope protein, a ZIKV non-structural protein 1, a ZIKV non-structural protein 2A, a ZIKV non-structural protein 2B, a ZIKV non-structural protein 3, a ZIKV non-structural protein 4A, a ZIKV non-structural protein 4B, or a ZIKV non-structural protein 5.

In some embodiments, the vaccine comprises a RNA polynucleotide having an open reading frame encoding a ZIKV capsid protein, a RNA polynucleotide having an open reading frame encoding a ZIKV premembrane/membrane protein, and a RNA polynucleotide having an open reading frame encoding a ZIKV envelope protein.

In some embodiments, the vaccine comprises a RNA polynucleotide having an open reading frame encoding a ZIKV capsid protein and a RNA polynucleotide having an open reading frame encoding a ZIKV premembrane/membrane protein.

In some embodiments, the vaccine comprises a RNA polynucleotide having an open reading frame encoding a ZIKV capsid protein and a RNA polynucleotide having an open reading frame encoding a ZIKV envelope protein.

In some embodiments, the vaccine comprises a RNA polynucleotide having an open reading frame encoding a ZIKV premembrane/membrane protein and a RNA polynucleotide having an open reading frame encoding a ZIKV envelope protein.

In some embodiments, the vaccine comprises a RNA polynucleotide having an open reading frame encoding a ZIKV capsid protein and at least one RNA polynucleotide having an open reading frame encoding any one or more of a ZIKV non-structural protein 1, 2A, 2B, 3, 4A, 4B or 5.

In some embodiments, the vaccine comprises a RNA polynucleotide having an open reading frame encoding a ZIKV premembrane/membrane protein and at least one RNA polynucleotide having an open reading frame encoding any one or more of a ZIKV non-structural protein 1, 2A, 2B, 3, 4A, 4B or 5.

In some embodiments, the vaccine comprises a RNA polynucleotide having an open reading frame encoding a ZIKV envelope protein and at least one RNA polynucleotide having an open reading frame encoding any one or more of a ZIKV non-structural protein 1, 2A, 2B, 3, 4A, 4B or 5.

In some embodiments, the at least one antigenic polypeptide comprises a combination of any two or more of a ZIKV capsid protein, a ZIKV premembrane/membrane protein, a ZIKV envelope protein, a ZIKV non-structural protein 1, a ZIKV non-structural protein 2A, a ZIKV non-structural protein 2B, a ZIKV non-structural protein 3, a ZIKV non-structural protein 4A, a ZIKV non-structural protein 4B, or a ZIKV non-structural protein 5.

In some embodiments, at least one RNA polynucleotide is encoded by at least one nucleic acid sequence identified by any one of SEQ ID NO: 118-136 (Table 25) and homologs having at least 80% identity with a nucleic acid sequence identified by any one of SEQ ID NO: 118-136 (Table 25). In some embodiments, at least one RNA polynucleotide is encoded by at least one nucleic acid sequence identified by any one of SEQ ID NO: 118-136 (Table 25) and homologs having at least 90% (90%, 91%, 92%, 93%, 94%, 95%, 96%, 97%, 98%, 99%, 99.8% or 99.9%) identity with a nucleic acid sequence identified by any one of SEQ ID NO: 118-136 (Table 25). In some embodiments, at least one RNA polynucleotide is encoded by at least one fragment of a nucleic acid sequence identified by any one of SEQ ID NO: 118-136 (Table 25).

In some embodiments, at least one RNA polynucleotide comprises at least one nucleic acid sequence identified by any one of SEQ ID NO: 137-155 (Table 25) and homologs having at least 80% identity with a nucleic acid sequence identified by any one of SEQ ID NO: 137-155 (Table 25). In some embodiments, at least one RNA polynucleotide comprises at least one nucleic acid sequence identified by any one of SEQ ID NO: 137-155 (Table 25) and homologs having at least 90% (90%, 91%, 92%, 93%, 94%, 95%, 96%, 97%, 98%, 99%, 99.8% or 99.9%) identity with a nucleic acid sequence identified by any one of SEQ ID NO: 137-155 (Table 25). In some embodiments, at least one RNA polynucleotide comprises at least one fragment of a nucleic acid sequence identified by any one of SEQ ID NO: 137-155 (Table 25).

In some embodiments, the at least one RNA polynucleotide encodes at least one antigenic polypeptide having a sequence identified by any one of SEQ ID NO: 156-222 or 469 (Table 26 and 27). In some embodiments, the at least one RNA polynucleotide encodes at least one protein variant having at least 95% identity to an antigenic polypeptide having a sequence identified by any one of SEQ ID NO: 156-222 or 469 (Table 26 and 27). In some embodiments, at least one antigenic polypeptide has an amino acid sequence identified by any one of SEQ ID NO: 156-222 or 469 (Table 26 and 27). In some embodiments, at least one antigenic polypeptide has at least 95% identity to an antigenic polypeptide having a sequence identified by any one of SEQ ID NO: 156-222 or 469 (Table 26 and 27).

Dengue Virus (DENV)

Dengue virus (DENV) is a mosquito-borne (*Aedes aegypti/Aedes albopictus*) member of the family Flaviviridae (positive-sense, single-stranded RNA virus). Dengue virus is a positive-sense RNA virus of the *Flavivirus* genus of the Flaviviridae family, which also includes West Nile virus, Yellow Fever Virus, and Japanese Encephalitis virus. It is transmitted to humans through *Stegomyia aegypti* (formerly *Aedes*) mosquito vectors and is mainly found in the tropical and semitropical areas of the world, where it is endemic in Asia, the Pacific region, Africa, Latin America, and the Caribbean. The incidence of infections has increased 30-fold over the last 50 years (WHO, *Dengue: Guidelines for diagnosis, treatment, prevention, and control* (2009)) and Dengue virus is the second most common tropical infectious disease worldwide after malaria.

Severe disease is most commonly observed in secondary, heterologous DENV infections. Antibody-dependent enhancement of infection has been proposed as the primary mechanism of dengue immunopathogenesis. The potential risk of immune enhancement of infection and disease underscores the importance of developing dengue vaccines which produce balanced, long-lasting immunity to at least DENV 1-4, if not all five of the DENV serotypes. While several dengue vaccines are in development, none have been officially licensed and/or approved to date.

In view of the lack of Dengue virus (DENV) vaccines, there is a significant need for a vaccine that would be safe and effective in all patient populations to prevent and/or to treat DENV infection, including those individuals at risk for secondary, heterotypic infections (those with more than one circulating serotype).

Some embodiments of the present disclosure provide Dengue virus (DENV) vaccines that include at least one ribonucleic acid (RNA) polynucleotide (e.g., mRNA polynucleotide) having an open reading frame encoding at least one DENV antigenic polypeptide or an immunogenic fragment thereof (e.g., an immunogenic fragment capable of inducing an immune response to DENV).

The methods of the present disclosure, in some embodiments, enable the production of highly antigenic DENV RNA vaccines, including RNA polynucleotides encoding concatemeric peptide epitopes. The peptide epitopes are designed to be processed intracellularly and presented to the immune system in an efficient manner. The RNA (e.g., mRNA) vaccines described herein are useful for generating a desired immune response by selecting appropriate T or B cell epitopes which are able to be presented more effectively on MHC-I or MHC-II molecules (depending on whether they are T or B-cell epitopes, respectively).

In some embodiments, the at least one RNA polynucleotide encodes a DENV capsid protein or immunogenic fragment or epitope thereof. In some embodiments, the at least one RNA polynucleotide encodes a DENV membrane protein or immunogenic fragment or epitope thereof. In some embodiments, the at least one RNA polynucleotide encodes a DENV precursor-membrane protein or immunogenic fragment or epitope thereof. In some embodiments, the at least one RNA polynucleotide encodes a DENV precursor membrane (prM) and envelope (E) polypeptide (DENV prME) or immunogenic fragment or epitope thereof. In some embodiments, the at least one RNA (e.g., mRNA) polynucleotide encodes a DENV nonstructural protein or immunogenic fragment or epitope thereof, for example a DENV non-structural protein selected from NS1, NS2A, NS2B, NS3, NS4A, NS4B, and NS5 proteins, or immunogenic fragments or epitopes thereof. In some embodiments, the DENV non-structural protein is NS3.

In some embodiments, the Dengue virus antigen comprises one or more Dengue virus peptide epitopes. In some embodiments, the one or more Dengue virus peptide epitopes is from a DENV envelope protein. In some embodiments, the one or more Dengue virus peptide epitopes is from a DENV capsid protein. In some embodiments, the one or more Dengue virus peptide epitopes is from a DENV membrane protein. In some embodiments, the one or more Dengue virus peptide epitopes is from a DENV pre-membrane protein. In some embodiments, the one or more Dengue virus peptide epitopes is from a sequence comprising DENV precursor membrane (prM) and envelope (E) polypeptide (DENV prME). In some embodiments, the at least one Dengue virus antigen is a DENV2 prME peptide epitope. In some embodiments, the one or more Dengue virus peptide epitopes is from a DENV nonstructural protein.

In any of these embodiments, the at least one RNA (e.g., mRNA) polynucleotide encodes a DENV polypeptide, fragment, or epitope from a DENV serotype selected from DENV-1, DENV-2, DENV-3, DENV-4, and DENV-5. In some embodiments, the one or more Dengue virus peptide epitopes is from a DENV-2 serotype. In some embodiments, the one or more Dengue virus peptide epitopes is from a DENV2 membrane polypeptide. In some embodiments, the one or more Dengue virus peptide epitopes is from a DENV2 envelope polypeptide. In some embodiments, the one or more Dengue virus peptide epitopes is from a DENV2 pre-membrane polypeptide. In some embodiments, the one or more Dengue virus peptide epitopes is from a DENV2 capsid polypeptide. In some embodiments, the one or more Dengue virus peptide epitopes is from a DENV2 non-structural polypeptide. In some embodiments, the one or more Dengue virus peptide epitopes is from a DENV2 pre-membrane polypeptide. In some embodiments, the one or more Dengue virus peptide epitopes is from a DENV2 PrME polypeptide.

In some embodiments, the Dengue virus antigen is a concatemeric Dengue virus antigen comprising two or more Dengue virus peptide epitopes. In some embodiments, the Dengue virus concatemeric antigen comprises between 2-100 Dengue peptide epitopes interspersed by cleavage sensitive sites. In some embodiments, the peptide epitopes are not epitopes of antibody dependent enhancement. In some embodiments, the Dengue virus vaccine's peptide epitopes are T cell epitopes and/or B cell epitopes. In other embodiments, the Dengue virus vaccine's peptide epitopes comprise a combination of T cell epitopes and B cell epitopes. In some embodiments, at least one of the peptide epitopes of the Dengue virus vaccine is a T cell epitope.

In some embodiments, the protease cleavage site of the Dengue virus vaccine comprises the amino acid sequence GFLG (SEQ ID NO: 429), KVSR (SEQ ID NO: 430), TVGLR (SEQ ID NO: 431), PMGLP (SEQ ID NO: 432), or PMGAP (SEQ ID NO: 433).

In some embodiments, the at least one RNA polynucleotide encodes a DENV envelope protein, and one or more concatemeric Dengue virus antigen(s), such as any of the concatemeric antigens described herein. In some embodiments, the at least one RNA polynucleotide encodes a DENV membrane protein, and a concatemeric virus antigen, such as any of the concatemeric antigens described herein. In some embodiments, the at least one RNA polynucleotide encodes a DENV capsid protein and a concatemeric virus antigen, such as any of the concatemeric antigens described herein. In some embodiments, the at least one RNA polynucleotide encodes a DENV nonstructural protein, for example a DENV non-structural protein selected from NS1, NS2A, NS2B, NS3, SN4A, NS4B, and NS5 proteins, and a concatemeric Dengue virus antigen, such as any of the concatemeric antigens described herein. In some embodiments, the DENV non-structural protein is NS3. In some embodiments, the at least one RNA polynucleotide encodes a DENV precursor membrane protein, and one or more concatemeric Dengue virus antigen(s), such as any of the concatemeric antigens described herein. In some embodiments, the at least one RNA polynucleotide encodes a DENV prME polypeptide, and one or more concatemeric Dengue virus antigen(s), such as any of the concatemeric antigens described herein.

In some embodiments, the peptide epitopes comprise at least one MHC class I epitope and at least one MHC class II epitope. In some embodiments, at least 10% of the epitopes are MHC class I epitopes. In some embodiments, at least 20% of the epitopes are MHC class I epitopes. In some embodiments, at least 30% of the epitopes are MHC class I epitopes. In some embodiments, at least 40% of the epitopes are MHC class I epitopes. In some embodiments, at least 50%, 60%, 70%, 80%, 90% or 100% of the epitopes are MHC class I epitopes. In some embodiments, at least 10% of the epitopes are MHC class II epitopes. In some embodiments, at least 20% of the epitopes are MHC class II epitopes. In some embodiments, at least 30% of the epitopes are MHC class II epitopes. In some embodiments, at least 40% of the epitopes are MHC class II epitopes. In some embodiments, at least 50%, 60%, 70%, 80%, 90% or 100% of the epitopes are MHC class II epitopes. In some embodiments, the ratio of MHC class I epitopes to MHC class II epitopes is a ratio selected from about 10%:about 90%; about 20%:about 80%; about 30%:about 70%; about 40%:about 60%; about 50%:about 50%; about 60%:about 40%; about 70%:about 30%; about 80%:about 20%; about 90%:about 10% MHC class 1:MHC class II epitopes. In some embodiments, the ratio of MHC class II epitopes to MHC class I epitopes is a ratio selected from about 10%:about 90%; about 20%:about 80%; about 30%:about 70%; about 40%:about 60%; about 50%:about 50%; about 60%:about 40%; about 70%:about 30%; about 80%:about 20%; about 90%:about 10% MHC class 1:MHC class I epitopes. In some embodiments, at least one of the peptide epitopes of the Dengue virus vaccine is a B cell epitope. In some embodiments, the T cell epitope of the Dengue virus vaccine comprises between 8-11 amino acids. In some embodiments, the B cell epitope of the Dengue virus vaccine comprises between 13-17 amino acids.

In any of these embodiments, the concatemeric Dengue virus antigen may comprise two or more Dengue virus peptide epitopes selected from a DENV envelope polypeptide, DENV capsid polypeptide, DENV membrane polypeptide, DENV precursor-membrane polypeptide, DENV non-structural polypeptide, DENV prME polypeptide, and any combination thereof, and the two or more Dengue virus peptide epitopes may be from any DENV serotype, for example, a DENV serotype selected from DENV-1, DENV-2, DENV-3, DENV-4, DENV-5 and combinations thereof. In some embodiments, the concatemeric Dengue virus antigen comprises two or more Dengue virus peptide epitopes from DENV-2 serotype. In some embodiments, the concatemeric Dengue virus antigen comprises two or more DENV2 prME peptide epitopes, which may be the same or different DENV prME peptide epitopes.

In some embodiments, at least one RNA polynucleotide is encoded by at least one nucleic acid sequence identified by any one of SEQ ID NO: 223-239 (Table 28) and homologs having at least 80% identity with a nucleic acid sequence identified by any one of SEQ ID NO: 223-239 (Table 28). In some embodiments, at least one RNA polynucleotide is encoded by at least one nucleic acid sequence identified by any one of SEQ ID NO: 223-239 (Table 28) and homologs having at least 90% (90%, 91%, 92%, 93%, 94%, 95%, 96%, 97%, 98%, 99%, 99.8% or 99.9%) identity with a nucleic acid sequence identified by any one of SEQ ID NO: 223-239 (Table 28). In some embodiments, at least one RNA polynucleotide is encoded by at least one fragment of a nucleic acid sequence identified by any one of SEQ ID NO: 223-239 (Table 28).

In some embodiments, at least one RNA polynucleotide comprises at least one nucleic acid sequence identified by any one of SEQ ID NO: 240-256 (Table 28) and homologs having at least 80% identity with a nucleic acid sequence identified by any one of SEQ ID NO: 240-256 (Table 28). In some embodiments, at least one RNA polynucleotide comprises at least one nucleic acid sequence identified by any one of SEQ ID NO: 240-256 (Table 28) and homologs having at least 90% (90%, 91%, 92%, 93%, 94%, 95%, 96%, 97%, 98%, 99%, 99.8% or 99.9%) identity with a nucleic acid sequence identified by any one of SEQ ID NO: 240-256 (Table 28). In some embodiments, at least one RNA polynucleotide comprises at least one fragment of a nucleic acid sequence identified by any one of SEQ ID NO: 240-256 (Table 28).

In some embodiments, the at least one RNA polynucleotide encodes at least one antigenic polypeptide having a sequence identified by any one of SEQ ID NO: 259-291 (Table 29 and 42). In some embodiments, the at least one RNA polynucleotide encodes at least one protein variant having at least 95% identity to an antigenic polypeptide having a sequence identified by any one of SEQ ID NO: 259-291 (Table 29 and 42). In some embodiments, at least one antigenic polypeptide has an amino acid sequence identified by any one of SEQ ID NO: 259-291 (Table 29 and 42). In some embodiments, at least one antigenic polypeptide has at least 95% identity to an antigenic polypeptide having a sequence identified by any one of SEQ ID NO: 259-291 (Table 29 and 42).

Chikungunya Virus (CHIKV)

Some embodiments of the present disclosure provide Chikungunya virus (CHIKV) vaccines that include at least one ribonucleic acid (RNA) polynucleotide (e.g., mRNA polynucleotide) having an open reading frame encoding at least one CHIKV antigenic polypeptide or an immunogenic fragment thereof (e.g., an immunogenic fragment capable of inducing an immune response to CHIKV).

Chikungunya virus (CHIKV) is a mosquito-borne virus belonging to the Alphavirus genus of the Togaviridae family that was first isolated in 1953 in Tanzania, where the virus was endemic. Outbreaks occur repeatedly in west, central, and southern Africa and have caused several human epidemics in those areas since that time. The virus is passed to humans by two species of mosquito of the genus *Aedes*: *A. albopictus* and *A. aegypti*. There are several Chikungunya genotypes: Indian Ocean, East/Central/South African (ECSA), Asian, West African, and Brazilian.

The CHIKV antigenic polypeptide may be a Chikungunya structural protein or an antigenic fragment or epitope thereof. In some embodiments, the antigenic polypeptide is a CHIKV structural protein or an antigenic fragment thereof. For example, a CHIKV structural protein may be an envelope protein (E), a 6K protein, or a capsid (C) protein. In some embodiments, the CHIKV structural protein is an envelope protein selected from E1, E2, and E3. In some embodiments, the CHIKV structural protein is E1 or E2. In some embodiments, the CHIKV structural protein is a capsid protein. In some embodiments, the antigenic polypeptide is a fragment or epitope of a CHIKV structural protein.

In some embodiments, the antigenic polypeptide comprises two or more CHIKV structural proteins. In some embodiments, the two or more CHIKV structural proteins are envelope proteins. In some embodiments, the two or more CHIKV structural proteins are E1 and E2. In some embodiments, the two or more CHIKV structural proteins are E1 and E3. In some embodiments, the two or more CHIKV structural proteins are E2 and E3. In some embodiments, the two or more CHIKV structural proteins are E1, E2, and E3. In some embodiments, the two or more CHIKV structural proteins are envelope and capsid proteins. In some embodiments, the two or more CHIKV structural proteins are E1 and C. In some embodiments, the two or more CHIKV structural proteins are E2 and C. In some embodiments, the two or more CHIKV structural proteins are E3 and C. In some embodiments, the two or more CHIKV structural proteins are E1, E2, and C. In some embodiments, the two or more CHIKV structural proteins are E1, E3, and C. In some embodiments, the two or more CHIKV structural proteins are E2, E3, and C. In some embodiments, the two or more CHIKV structural proteins are E1, E2, E3, and C. In some embodiments, the two or more CHIKV structural proteins are E1, 6K, and E2. In some embodiments, the two or more CHIKV structural proteins are E2, 6K, and E3. In some embodiments, the two or more CHIKV structural proteins are E1, 6K, and E3. In some embodiments, the two or more CHIKV structural proteins are E1, E2, E3, 6K, and C. In some embodiments, the antigenic polypeptide comprises the CHIKV structural polyprotein comprising C, E3, E2, 6K, and E1. In some embodiments, the antigenic polypeptide is a fragment or epitope of two or more CHIKV structural proteins or a fragment or epitope of the polyprotein.

In some embodiments, at least one RNA polynucleotide is encoded by at least one nucleic acid sequence identified by any one of SEQ ID NO: 376-388 (Table 47) and homologs having at least 80% identity with a nucleic acid sequence identified by any one of SEQ ID NO: 376-388 (Table 47). In some embodiments, at least one RNA polynucleotide is encoded by at least one nucleic acid sequence identified by any one of SEQ ID NO: 376-388 (Table 47) and homologs having at least 90% (90%, 91%, 92%, 93%, 94%, 95%, 96%, 97%, 98%, 99%, 99.8% or 99.9%) identity with a nucleic acid sequence identified by any one of SEQ ID NO: 376-388 (Table 47). In some embodiments, at least one RNA polynucleotide is encoded by at least one fragment of a nucleic acid sequence identified by any one of SEQ ID NO: 376-388 (Table 47).

In some embodiments, at least one RNA polynucleotide comprises at least one nucleic acid sequence identified by any one of SEQ ID NO: 389-401 (Table 47) and homologs having at least 80% identity with a nucleic acid sequence identified by any one of SEQ ID NO: 389-401 (Table 47). In some embodiments, at least one RNA polynucleotide comprises at least one nucleic acid sequence identified by any one of SEQ ID NO: 389-401 (Table 47) and homologs having at least 90% (90%, 91%, 92%, 93%, 94%, 95%, 96%, 97%, 98%, 99%, 99.8% or 99.9%) identity with a nucleic acid sequence identified by any one of SEQ ID NO: 389-401 (Table 47). In some embodiments, at least one RNA polynucleotide comprises at least one fragment of a nucleic acid sequence identified by any one of SEQ ID NO: 389-401 (Table 47).

In some embodiments, the at least one RNA polynucleotide encodes at least one antigenic polypeptide having a sequence identified by any one of SEQ ID NO: 402-413 (Table 48). In some embodiments, the at least one RNA polynucleotide encodes at least one protein variant having at least 95% identity to an antigenic polypeptide having a sequence identified by any one of SEQ ID NO: 402-413 (Table 48). In some embodiments, at least one antigenic polypeptide has an amino acid sequence identified by any one of SEQ ID NO: 402-413 (Table 48). In some embodiments, at least one antigenic polypeptide has at least 95% identity to an antigenic polypeptide having a sequence identified by any one of SEQ ID NO: 402-413 (Table 48).

In some embodiments, an open reading frame of a RNA (e.g., mRNA) vaccine is codon-optimized. In some embodiments, at least one RNA polynucleotide encodes at least one antigenic polypeptide comprising an amino acid sequence identified by any one of SEQ ID NO: 13-17, 22-29, 44-47, 52-54, 59-64, 97-117, 156-222, 469, 259-291 or 402-413 and is codon optimized mRNA.

In some embodiments, a RNA (e.g., mRNA) vaccine further comprising an adjuvant.

Tables 3, 6, 11, 14, 17, 27, and 42 provide National Center for Biotechnology Information (NCBI) accession numbers of interest. It should be understood that the phrase "an amino acid sequence of Tables 3, 6, 11, 14, 17, 27, and 42" refers to an amino acid sequence identified by one or more NCBI accession numbers listed in Tables 3, 6, 11, 14, 17, 27, and 42. Each of the amino acid sequences, and variants having greater than 95% identity or greater than 98% identity to each of the amino acid sequences encompassed by the accession numbers of Tables 3, 6, 11, 14, 17, 27, and 42 are included within the constructs (polynucleotides/polypeptides) of the present disclosure.

In some embodiments, at least one mRNA polynucleotide is encoded by a nucleic acid comprising a sequence identified by any one of SEQ ID NO: 1-6, 18, 19, 30-34, 48, 49, 55, 56, 65-80, 118-136, 223-239 or 376-388 and having less than 80% identity to wild-type mRNA sequence. In some embodiments, at least one mRNA polynucleotide is encoded by a nucleic acid comprising a sequence identified by any one of SEQ ID NO: 1-6, 18, 19, 30-34, 48, 49, 55, 56, 65-80, 118-136, 223-239 or 376-388 and having less than 75%, 85% or 95% identity to a wild-type mRNA sequence. In some embodiments, at least one mRNA polynucleotide is encoded by nucleic acid comprising a sequence identified by any one of SEQ ID NO: 1-6, 18, 19, 30-34, 48, 49, 55, 56, 65-80, 118-136, 223-239 or 376-388 and having less than 50-80%, 60-80%, 40-80%, 30-80%, 70-80%, 75-80% or 78-80% identity to wild-type mRNA sequence. In some embodiments, at least one mRNA polynucleotide is encoded by a nucleic acid comprising a sequence identified by any one of SEQ ID NO: 1-6, 18, 19, 30-34, 48, 49, 55, 56, 65-80, 118-136, 223-239 or 376-388 and having less than 40-85%, 50-85%, 60-85%, 30-85%, 70-85%, 75-85% or 80-85% identity to wild-type mRNA sequence. In some embodiments, at least one mRNA polynucleotide is encoded by a nucleic acid comprising a sequence identified by any one of SEQ ID NO: 1-6, 18, 19, 30-34, 48, 49, 55, 56, 65-80, 118-136, 223-239 or 376-388 and having less than 40-90%, 50-90%, 60-90%, 30-90%, 70-90%, 75-90%, 80-90%, or 85-90% identity to wild-type mRNA sequence.

In some embodiments, at least one mRNA polynucleotide comprises a nucleic acid comprising a sequence identified by any one of SEQ ID NO: 7-12, 20-21, 35-39, 50-51, 57-58, 81-96, 137-155, 240-256, or 389-401 (with or without a signal sequence, 5' UTR, 3' UTR, and/or polyA tail) and having less than 80% identity to wild-type mRNA sequence. In some embodiments, at least one mRNA polynucleotide comprises a nucleic acid comprising a sequence identified by any one of SEQ ID NO: 7-12, 20-21, 35-39, 50-51, 57-58, 81-96, 137-155, 240-256, or 389-401 (with or without a signal sequence, 5' UTR, 3' UTR, and/or polyA tail) and having less than 75%, 85% or 95% identity to a wild-type mRNA sequence. In some embodiments, at least one mRNA polynucleotide comprises nucleic acid comprising a sequence identified by any one of SEQ ID NO: 7-12, 20-21, 35-39, 50-51, 57-58, 81-96, 137-155, 240-256, or 389-401 (with or without a signal sequence, 5' UTR, 3' UTR, and/or polyA tail) and having less than 50-80%, 60-80%, 40-80%, 30-80%, 70-80%, 75-80% or 78-80% identity to wild-type mRNA sequence. In some embodiments, at least one mRNA polynucleotide comprises a nucleic acid comprising a sequence identified by any one of SEQ ID NO: 7-12, 20-21, 35-39, 50-51, 57-58, 81-96, 137-155, 240-256, or 389-401 (with or without a signal sequence, 5' UTR, 3' UTR, and/or polyA tail) and having less than 40-85%, 50-85%, 60-85%, 30-85%, 70-85%, 75-85% or 80-85% identity to wild-type mRNA sequence. In some embodiments, at least one mRNA polynucleotide comprises a nucleic acid comprising a sequence identified by any one of SEQ ID NO: 7-12, 20-21, 35-39, 50-51, 57-58, 81-96, 137-155, 240-256, or 389-401 (with or without a signal sequence, 5' UTR, 3' UTR, and/or polyA tail) and having less than 40-90%, 50-90%, 60-90%, 30-90%, 70-90%, 75-90%, 80-90%, or 85-90% identity to wild-type mRNA sequence.

In some embodiments, at least one RNA polynucleotide encodes at least one antigenic polypeptide comprising an amino acid sequence identified by any one of SEQ ID NO: 13-17, 22-29, 44-47, 52-54, 59-64, 97-117, 156-222, 469, 259-291 or 402-413 and having at least 80% (e.g., 85%, 90%, 95%, 98%, 99%) identity to wild-type mRNA sequence, but does not include wild-type mRNA sequence.

In some embodiments, at least one RNA polynucleotide encodes at least one antigenic polypeptide comprising an amino acid sequence identified by any one of SEQ ID NO: 13-17, 22-29, 44-47, 52-54, 59-64, 97-117, 156-222, 469, 259-291 or 402-413 and has less than 95%, 90%, 85%, 80% or 75% identity to wild-type mRNA sequence. In some embodiments, at least one RNA polynucleotide encodes at least one antigenic polypeptide comprising an amino acid sequence identified by any one of SEQ ID NO: 13-17, 22-29, 44-47, 52-54, 59-64, 97-117, 156-222, 469, 259-291 or 402-413 and has 30-80%, 40-80%, 50-80%, 60-80%, 70-80%, 75-80% or 78-80%, 30-85%, 40-85%, 50-85%, 60-85%, 70-85%, 75-85% or 78-85%, 30-90%, 40-90%, 50-90%, 60-90%, 70-90%, 75-90%, 80-90% or 85-90% identity to wild-type mRNA sequence.

In some embodiments, at least one RNA polynucleotide encodes at least one antigenic polypeptide having at least 90%, at least 95%, at least 96%, at least 97%, at least 98%, or at least 99% identity to an amino acid sequence identified by any one of SEQ ID NO: 13-17, 22-29, 44-47, 52-54, 59-64, 97-117, 156-222, 469, 259-291 or 402-413. In some embodiments, at least one RNA polynucleotide encodes at least one antigenic polypeptide having 95-99% identity to an amino acid sequence identified by any one of SEQ ID NO: 13-17, 22-29, 44-47, 52-54, 59-64, 97-117, 156-222, 469, 259-291 or 402-413.

In some embodiments, at least one RNA polynucleotide encodes at least one antigenic polypeptide having at least 90%, at least 95%, at least 96%, at least 97%, at least 98%, or at least 99% identity to amino acid sequence identified by any one of SEQ ID NO: 13-17, 22-29, 44-47, 52-54, 59-64, 97-117, 156-222, 469, 259-291 or 402-413 and having membrane fusion activity. In some embodiments, at least one RNA polynucleotide encodes at least one antigenic polypeptide having 95-99% identity to amino acid sequence identified by any one of SEQ ID NO: 13-17, 22-29, 44-47, 52-54, 59-64, 97-117, 156-222, 469, 259-291 or 402-413 and having membrane fusion activity.

In some embodiments, at least one RNA polynucleotide encodes at least one antigenic polypeptide (e.g., at least one Malaria (e.g., *P. falciparum, P. vivax, P. Malariae* and/or *P. ovale*), JEV, WNV, EEEV, VEEV, SINV, CHIKV, DENV, ZIKV and/or YFV antigenic polypeptide) that attaches to cell receptors.

In some embodiments, at least one RNA polynucleotide encodes at least one antigenic polypeptide (e.g., at least one Malaria (e.g., *P. falciparum, P. vivax, P. Malariae* and/or *P. ovale*), JEV, WNV, EEEV, VEEV, SINV, CHIKV, DENV, ZIKV and/or YFV antigenic polypeptide) antigenic polypeptide) that causes fusion of viral and cellular membranes.

In some embodiments, at least one RNA polynucleotide encodes at least one antigenic polypeptide (e.g., at least one Malaria (e.g., *P. falciparum, P. vivax, P. Malariae* and/or *P. ovale*), JEV, WNV, EEEV, VEEV, SINV, CHIKV, DENV, ZIKV and/or YFV antigenic polypeptide) that is responsible for binding of the virus to a cell being infected.

Some embodiments of the present disclosure provide a vaccine that includes at least one ribonucleic acid (RNA) (e.g., mRNA) polynucleotide having an open reading frame encoding at least one antigenic polypeptide (e.g., at least one Malaria (e.g., *P. falciparum, P. vivax, P. Malariae* and/or *P. ovale*), JEV, WNV, EEEV, VEEV, SINV, CHIKV, DENV, ZIKV and/or YFV antigenic polypeptide), at least one 5' terminal cap and at least one chemical modification, formulated within a lipid nanoparticle.

In some embodiments, a 5' terminal cap is 7mG(5')ppp (5')NlmpNp.

In some embodiments, at least one chemical modification is selected from pseudouridine, N1-methylpseudouridine, N1-ethylpseudouridine, 2-thiouridine, 4'-thiouridine, 5-methylcytosine, 5-methyluridine, 2-thio-1-methyl-1-deaza-pseudouridine, 2-thio-1-methyl-pseudouridine, 2-thio-5-aza-uridine, 2-thio-dihydropseudouridine, 2-thio-dihydrouridine, 2-thio-pseudouridine, 4-methoxy-2-thio-pseudouridine, 4-methoxy-pseudouridine, 4-thio-1-methyl-pseudouridine, 4-thio-pseudouridine, 5-aza-uridine, dihydropseudouridine, 5-methoxyuridine and 2'-O-methyl uridine. In some embodiments, the chemical modification is in the 5-position of the uracil. In some embodiments, the chemical modification is a N1-methylpseudouridine or a N1-ethylpseudouridine. In some embodiments, a lipid nanoparticle comprises a cationic lipid, a PEG-modified lipid, a sterol and a non-cationic lipid. In some embodiments, a cationic lipid is an ionizable cationic lipid and the non-cationic lipid is a neutral lipid, and the sterol is a cholesterol.

In some embodiments, a cationic lipid is selected from the group consisting of 2,2-dilinoleyl-4-dimethylaminoethyl-[1,3]-dioxolane (DLin-KC2-DMA), dilinoleyl-methyl-4-dimethylaminobutyrate (DLin-MC3-DMA), di((Z)-non-2-en-1-yl) 9-((4-(dimethylamino)butanoyl)oxy)heptadecanedioate (L319), (12Z,15Z)—N,N-dimethyl-2-nonylhenicosa-12,15-dien-1-amine (L608), and N,N-dimethyl-1-[(1S,2R)-2-octylcyclopropyl]heptadecan-8-amine (L530).

In some embodiments, the lipid is (L608)

In some embodiments, the lipid is (L530)

In some embodiments, a lipid nanoparticle comprises compounds of Formula (I) and/or Formula (II), discussed below.

In some embodiments, a lipid nanoparticle comprises Compounds 3, 18, 20, 25, 26, 29, 30, 60, 108-112, or 122, as discussed below.

Some embodiments of the present disclosure provide a vaccine that includes at least one RNA (e.g., mRNA) polynucleotide having an open reading frame encoding at least one antigenic polypeptide (e.g., at least one Malaria (e.g., *P. falciparum, P. vivax, P. Malariae* and/or *P. ovale*), JEV, WNV, EEEV, VEEV, SINV, CHIKV, DENV, ZIKV and/or YFV antigenic polypeptide), wherein at least 80% (e.g., 85%, 90%, 95%, 98%, 99%) of the uracil in the open reading frame have a chemical modification, optionally wherein the vaccine is formulated in a lipid nanoparticle (e.g., a lipid nanoparticle comprises a cationic lipid, a PEG-modified lipid, a sterol and a non-cationic lipid).

In some embodiments, 100% of the uracil in the open reading frame have a chemical modification. In some embodiments, a chemical modification is in the 5-position of the uracil. In some embodiments, a chemical modification is a N1-methyl pseudouridine. In some embodiments, 100% of the uracil in the open reading frame have a N1-methyl pseudouridine in the 5-position of the uracil.

In some embodiments, an open reading frame of a RNA (e.g., mRNA) polynucleotide encodes at least two antigenic polypeptides (e.g., at least one Malaria (e.g., *P. falciparum, P. vivax, P. Malariae* and/or *P. ovale*), JEV, WNV, EEEV, VEEV, SINV, CHIKV, DENV, ZIKV and/or YFV antigenic polypeptide). In some embodiments, the open reading frame encodes at least five or at least ten antigenic polypeptides. In some embodiments, the open reading frame encodes at least 100 antigenic polypeptides. In some embodiments, the open reading frame encodes 2-100 antigenic polypeptides.

In some embodiments, a vaccine comprises at least two RNA (e.g., mRNA) polynucleotides, each having an open reading frame encoding at least one antigenic polypeptide (e.g., at least one Malaria (e.g., *P. falciparum, P. vivax, P. Malariae* and/or *P. ovale*), JEV, WNV, EEEV, VEEV, SINV, CHIKV, DENV, ZIKV and/or YFV antigenic polypeptide). In some embodiments, the vaccine comprises at least five or at least ten RNA (e.g., mRNA) polynucleotides, each having an open reading frame encoding at least one antigenic polypeptide or an immunogenic fragment thereof. In some embodiments, the vaccine comprises at least 100 RNA (e.g., mRNA) polynucleotides, each having an open reading frame encoding at least one antigenic polypeptide. In some embodiments, the vaccine comprises 2-100 RNA (e.g., mRNA) polynucleotides, each having an open reading frame encoding at least one antigenic polypeptide.

In some embodiments, at least one antigenic polypeptide (e.g., at least one Malaria (e.g., *P. falciparum, P. vivax, P. Malariae* and/or *P. ovale*), JEV, WNV, EEEV, VEEV, SINV, CHIKV, DENV, ZIKV and/or YFV antigenic polypeptide) is fused to a signal peptide. In some embodiments, the signal peptide is selected from: a HuIgGk signal peptide (METPAQLLFLLLLWLPDTTG; SEQ ID NO: 423); IgE heavy chain epsilon-1 signal peptide (MDWTWILFLVAAATRVHS; SEQ ID NO: 424); Japanese encephalitis PRM signal sequence (MLGSNSGQRVVFTILLLLVAPAYS; SEQ ID NO: 425), VSINVg protein signal sequence (MKCLLYLAFLFIGVNCA; SEQ ID NO: 426) and Japanese encephalitis JEV signal sequence (MWLVSLAIVTACAGA; SEQ ID NO: 427).

In some embodiments, the signal peptide is fused to the N-terminus of at least one antigenic polypeptide. In some embodiments, a signal peptide is fused to the C-terminus of at least one antigenic polypeptide.

In some embodiments, at least one antigenic polypeptide (e.g., at least one Malaria (e.g., *P. falciparum, P. vivax, P. Malariae* and/or *P. ovale*), JEV, WNV, EEEV, VEEV, SINV, CHIKV, DENV, ZIKV and/or YFV antigenic polypeptide) comprises a mutated N-linked glycosylation site.

Also provided herein is a RNA (e.g., mRNA) vaccine of any one of the foregoing paragraphs (e.g., at least one Malaria (e.g., *P. falciparum, P. vivax, P. Malariae* and/or *P. ovale*), JEV, WNV, EEEV, VEEV, SINV, CHIKV, DENV, ZIKV and/or YFV antigenic polypeptide), formulated in a nanoparticle (e.g., a lipid nanoparticle).

In some embodiments, the nanoparticle has a mean diameter of 50-200 nm. In some embodiments, the nanoparticle is a lipid nanoparticle.

In some embodiments, a lipid nanoparticle comprises compounds of Formula (I) and/or Formula (II), discussed below.

In some embodiments, a tropical disease RNA (e.g., mRNA) vaccine is formulated in a lipid nanoparticle that comprises a compound selected from Compounds 3, 18, 20, 25, 26, 29, 30, 60, 108-112 and 122, described below.

In some embodiments, the nanoparticle has a polydispersity value of less than 0.4 (e.g., less than 0.3, 0.2 or 0.1).

In some embodiments, the nanoparticle has a net neutral charge at a neutral pH value.

In some embodiments, the RNA (e.g., mRNA) vaccine is multivalent.

Some embodiments of the present disclosure provide methods of inducing an antigen specific immune response in a subject, comprising administering to the subject any of the RNA (e.g., mRNA) vaccine as provided herein in an amount effective to produce an antigen-specific immune response. In some embodiments, the RNA (e.g., mRNA) vaccine is a Malaria (e.g., *P. falciparum, P. vivax, P. Malariae* and/or *P. ovale*), JEV, WNV, EEEV, VEEV, SINV, CHIKV, DENV, ZIKV and/or YFV vaccine. In some embodiments, the RNA (e.g., mRNA) vaccine is a combination vaccine comprising a combination of Malaria (e.g., *P. falciparum, P. vivax, P. Malariae* and/or *P. ovale*) vaccine, JEV vaccine, WNV vaccine, EEEV vaccine, SINV vaccine, CHIKV vaccine, DENV vaccine, ZIKV vaccine and/or YFV vaccine.

In some embodiments, an antigen-specific immune response comprises a T cell response or a B cell response.

In some embodiments, a method of producing an antigen-specific immune response comprises administering to a subject a single dose (no booster dose) of a RNA (e.g., mRNA) vaccine of the present disclosure. In some embodiments, the RNA (e.g., mRNA) vaccine is a Malaria (e.g., *P. falciparum, P. vivax, P. Malariae* and/or *P. ovale*) vaccine, JEV vaccine, WNV vaccine, EEEV vaccine, SINV vaccine, CHIKV vaccine, DENV vaccine, ZIKV vaccine and/or YFV vaccine. In some embodiments, the RNA (e.g., mRNA) vaccine is a combination vaccine comprising a combination of any two or more of the foregoing vaccines.

In some embodiments, a method further comprises administering to the subject a second (booster) dose of a RNA (e.g., mRNA) vaccine. Additional doses of a RNA (e.g., mRNA) vaccine may be administered.

In some embodiments, the subjects exhibit a seroconversion rate of at least 80% (e.g., at least 85%, at least 90%, or at least 95%) following the first dose or the second (booster) dose of the vaccine. Seroconversion is the time period during which a specific antibody develops and becomes detectable in the blood. After seroconversion has occurred, a virus can be detected in blood tests for the antibody. During an infection or immunization, antigens enter the blood, and the immune system begins to produce antibodies in response. Before seroconversion, the antigen itself may or may not be detectable, but antibodies are considered absent. During seroconversion, antibodies are present but not yet detectable. Any time after seroconversion, the antibodies can be detected in the blood, indicating a prior or current infection.

In some embodiments, a RNA (e.g., mRNA) vaccine is administered to a subject by intradermal, intramuscular injection, or by intranasal administration.

Some embodiments of the present disclosure provide methods of inducing an antigen specific immune response in a subject, including administering to a subject a RNA (e.g., mRNA) vaccine in an effective amount to produce an antigen specific immune response in a subject. Antigen-specific immune responses in a subject may be determined, in some embodiments, by assaying for antibody titer (for titer of an antibody that binds to a Malaria (e.g., *P. falciparum, P. vivax, P. Malariae* and/or *P. ovale*), JEV, WNV, EEEV, VEEV, SINV, CHIKV, DENV, ZIKV and/or YFV antigenic polypeptide) following administration to the subject of any of the RNA (e.g., mRNA) vaccines of the present disclosure. In some embodiments, the anti-antigenic polypeptide antibody titer produced in the subject is increased by at least 1 log relative to a control. In some embodiments, the anti-antigenic polypeptide antibody titer produced in the subject is increased by 1-3 log relative to a control.

In some embodiments, the anti-antigenic polypeptide antibody titer produced in a subject is increased at least 2 times relative to a control. In some embodiments, the anti-antigenic polypeptide antibody titer produced in the subject is increased at least 5 times relative to a control. In some embodiments, the anti-antigenic polypeptide antibody titer produced in the subject is increased at least 10 times relative to a control. In some embodiments, the anti-antigenic polypeptide antibody titer produced in the subject is increased 2-10 times relative to a control.

In some embodiments, the control is an anti-antigenic polypeptide antibody titer produced in a subject who has not been administered a RNA (e.g., mRNA) vaccine of the present disclosure. In some embodiments, the control is an anti-antigenic polypeptide antibody titer produced in a subject who has been administered a live attenuated or inactivated Malaria (e.g., P. falciparum, P. vivax, P. Malariae and/or P. ovale), JEV, WNV, EEEV, VEEV, SINV, CHIKV, DENV, ZIKV and/or YFV vaccine (see, e.g., Ren J. et al. J of Gen. Virol. 2015; 96: 1515-1520), or wherein the control is an anti-antigenic polypeptide antibody titer produced in a subject who has been administered a recombinant or purified Malaria (e.g., P. falciparum, P. vivax, P. Malariae and/or P. ovale), JEV, WNV, EEEV, VEEV, SINV, CHIKV, DENV, ZIKV and/or YFV protein vaccine. In some embodiments, the control is an anti-antigenic polypeptide antibody titer produced in a subject who has been administered a Malaria (e.g., P. falciparum, P. vivax, P. Malariae and/or P. ovale), JEV, WNV, EEEV, VEEV, SINV, CHIKV, DENV, ZIKV and/or YFV virus-like particle (VLP) vaccine (see, e.g., Cox R G et al., J Virol. 2014 June; 88(11): 6368-6379).

A RNA (e.g., mRNA) vaccine of the present disclosure is administered to a subject in an effective amount (an amount effective to induce an immune response). In some embodiments, the effective amount is a dose equivalent to an at least 2-fold, at least 4-fold, at least 10-fold, at least 100-fold, at least 1000-fold reduction in the standard of care dose of a recombinant Malaria (e.g., P. falciparum, P. vivax, P. Malariae and/or P. ovale), JEV, WNV, EEEV, VEEV, SINV, CHIKV, DENV, ZIKV and/or YFV protein vaccine, wherein the anti-antigenic polypeptide antibody titer produced in the subject is equivalent to an anti-antigenic polypeptide antibody titer produced in a control subject administered the standard of care dose of a recombinant Malaria (e.g., P. falciparum, P. vivax, P. Malariae and/or P. ovale), JEV, WNV, EEEV, VEEV, SINV, CHIKV, DENV, ZIKV and/or YFV protein vaccine, a purified Malaria (e.g., P. falciparum, P. vivax, P. Malariae and/or P. ovale), JEV, WNV, EEEV, VEEV, SINV, CHIKV, DENV, ZIKV and/or YFV protein vaccine, a live attenuated Malaria (e.g., P. falciparum, P. vivax, P. Malariae and/or P. ovale), JEV, WNV, EEEV, VEEV, SINV, CHIKV, DENV, ZIKV and/or YFV vaccine, an inactivated Malaria (e.g., P. falciparum, P. vivax, P. Malariae and/or P. ovale), JEV, WNV, EEEV, VEEV, SINV, CHIKV, DENV, ZIKV and/or YFV vaccine, or a Malaria (e.g., P. falciparum, P. vivax, P. Malariae and/or P. ovale), JEV, WNV, EEEV, VEEV, SINV, CHIKV, DENV, ZIKV and/or YFV VLP vaccine. In some embodiments, the effective amount is a dose equivalent to 2-1000-fold reduction in the standard of care dose of a recombinant Malaria (e.g., P. falciparum, P. vivax, P. Malariae and/or P. ovale), JEV, WNV, EEEV, VEEV, SINV, CHIKV, DENV, ZIKV and/or YFV protein vaccine, wherein the anti-antigenic polypeptide antibody titer produced in the subject is equivalent to an anti-antigenic polypeptide antibody titer produced in a control subject administered the standard of care dose of a recombinant Malaria (e.g., P. falciparum, P. vivax, P. Malariae and/or P. ovale), JEV, WNV, EEEV, VEEV, SINV, CHIKV, DENV, ZIKV and/or YFV protein vaccine, a purified Malaria (e.g., P. falciparum, P. vivax, P. Malariae and/or P. ovale), JEV, WNV, EEEV, VEEV, SINV, CHIKV, DENV, ZIKV and/or YFV protein vaccine, a live attenuated Malaria (e.g., P. falciparum, P. vivax, P. Malariae and/or P. ovale), JEV, WNV, EEEV, VEEV, SINV, CHIKV, DENV, ZIKV and/or YFV vaccine, an inactivated Malaria (e.g., P. falciparum, P. vivax, P. Malariae and/or P. ovale), JEV, WNV, EEEV, VEEV, SINV, CHIKV, DENV, ZIKV and/or YFV vaccine, or a Malaria (e.g., P. falciparum, P. vivax, P. Malariae and/or P. ovale), JEV, WNV, EEEV, VEEV, SINV, CHIKV, DENV, ZIKV and/or YFV VLP vaccine.

In some embodiments, the control is an anti-antigenic polypeptide antibody titer produced in a subject who has been administered a virus-like particle (VLP) vaccine comprising structural proteins of Malaria (e.g., P. falciparum, P. vivax, P. Malariae and/or P. ovale), JEV, WNV, EEEV, VEEV, SINV, CHIKV, DENV, ZIKV and/or YFV.

In some embodiments, the RNA (e.g., mRNA) vaccine is formulated in an effective amount to produce an antigen specific immune response in a subject.

In some embodiments, the effective amount is a total dose of 25 µg to 1000 µg, or 50 µg to 1000 µg. In some embodiments, the effective amount is a total dose of 100 µg. In some embodiments, the effective amount is a dose of 25 µg administered to the subject a total of two times. In some embodiments, the effective amount is a dose of 100 µg administered to the subject a total of two times. In some embodiments, the effective amount is a dose of 400 µg administered to the subject a total of two times. In some embodiments, the effective amount is a dose of 500 µg administered to the subject a total of two times.

In some embodiments, the efficacy (or effectiveness) of a RNA (e.g., mRNA) vaccine is greater than 60%. In some embodiments, the RNA (e.g., mRNA) polynucleotide of the vaccine is at least one of Malaria (e.g., P. falciparum, P. vivax, P. malariae and/or P. ovale), JEV, WNV, EEEV, VEEV, SINV, CHIKV, DENV, ZIKV and/or YFV antigenic polypeptide.

Vaccine efficacy may be assessed using standard analyses (see, e.g., Weinberg et al., J Infect Dis. 2010 Jun. 1; 201(11):1607-10). For example, vaccine efficacy may be measured by double-blind, randomized, clinical controlled trials. Vaccine efficacy may be expressed as a proportionate reduction in disease attack rate (AR) between the unvaccinated (ARU) and vaccinated (ARV) study cohorts and can be calculated from the relative risk (RR) of disease among the vaccinated group with use of the following formulas:

Efficacy=(ARU−ARV)/ARU×100; and

Efficacy=(1−RR)×100.

Likewise, vaccine effectiveness may be assessed using standard analyses (see, e.g., Weinberg et al., J Infect Dis. 2010 Jun. 1; 201(11):1607-10). Vaccine effectiveness is an assessment of how a vaccine (which may have already proven to have high vaccine efficacy) reduces disease in a population. This measure can assess the net balance of benefits and adverse effects of a vaccination program, not just the vaccine itself, under natural field conditions rather than in a controlled clinical trial. Vaccine effectiveness is proportional to vaccine efficacy (potency) but is also affected by how well target groups in the population are immunized, as well as by other non-vaccine-related factors that influence the 'real-world' outcomes of hospitalizations, ambulatory visits, or costs. For example, a retrospective case control analysis may be used, in which the rates of vaccination among a set of infected cases and appropriate controls are compared. Vaccine effectiveness may be expressed as a rate difference, with use of the odds ratio (OR) for developing infection despite vaccination:

Effectiveness=(1−OR)×100.

In some embodiments, the efficacy (or effectiveness) of a RNA (e.g., mRNA) vaccine is at least 65%, at least 70%, at least 75%, at least 80%, at least 85%, or at least 90%.

In some embodiments, the vaccine immunizes the subject against Malaria (e.g., *P. falciparum, P. vivax, P. malariae* and/or *P. ovale*), JEV, WNV, EEEV, VEEV, SINV, CHIKV, DENV, ZIKV and/or YFV for up to 2 years. In some embodiments, the vaccine immunizes the subject against Malaria (e.g., *P. falciparum, P. vivax, P. malariae* and/or *P. ovale*), JEV, WNV, EEEV, VEEV, SINV, CHIKV, DENV, ZIKV and/or YFV for more than 2 years, more than 3 years, more than 4 years, or for 5-10 years.

In some embodiments, the subject is about 5 years old or younger. For example, the subject may be between the ages of about 1 year and about 5 years (e.g., about 1, 2, 3, 4 or 5 years), or between the ages of about 6 months and about 1 year (e.g., about 6, 7, 8, 9, 10, 11 or 12 months). In some embodiments, the subject is about 12 months or younger (e.g., 12, 11, 10, 9, 8, 7, 6, 5, 4, 3, 2 months or 1 month). In some embodiments, the subject is about 6 months or younger.

In some embodiments, the subject was born full term (e.g., about 37-42 weeks). In some embodiments, the subject was born prematurely, for example, at about 36 weeks of gestation or earlier (e.g., about 36, 35, 34, 33, 32, 31, 30, 29, 28, 27, 26 or 25 weeks). For example, the subject may have been born at about 32 weeks of gestation or earlier. In some embodiments, the subject was born prematurely between about 32 weeks and about 36 weeks of gestation. In such subjects, a RNA (e.g., mRNA) vaccine may be administered later in life, for example, at the age of about 6 months to about 5 years, or older.

In some embodiments, the subject is an adult between the ages of about 20 years and about 50 years (e.g., about 20, 25, 30, 35, 40, 45 or 50 years old).

In some embodiments, the subject is an elderly subject about 60 years old, about 70 years old, or older (e.g., about 60, 65, 70, 75, 80, 85 or 90 years old).

In some embodiments, the subject has been exposed to Malaria (e.g., *P. falciparum, P. vivax, P. Malariae* and/or *P. ovale*), JEV, WNV, EEEV, VEEV, SINV, CHIKV, DENV, ZIKV and/or YFV (e.g., *C. trachomatis*); the subject is infected with Malaria (e.g., *P. falciparum, P. vivax, P. Malariae* and/or *P. ovale*), JEV, WNV, EEEV, VEEV, SINV, CHIKV, DENV, ZIKV and/or YFV (e.g., *C. trachomatis*); or subject is at risk of infection by Malaria (e.g., *P. falciparum, P. vivax, P. Malariae* and/or *P. ovale*), JEV, WNV, EEEV, VEEV, SINV, CHIKV, DENV, ZIKV and/or YFV (e.g., *C. trachomatis*).

In some embodiments, the subject is immunocompromised (has an impaired immune system, e.g., has an immune disorder or autoimmune disorder).

In some embodiments the nucleic acid vaccines described herein are chemically modified. In other embodiments the nucleic acid vaccines are unmodified.

Yet other aspects provide compositions for and methods of vaccinating a subject comprising administering to the subject a nucleic acid vaccine comprising one or more RNA polynucleotides having an open reading frame encoding a first virus antigenic polypeptide, wherein the RNA polynucleotide does not include a stabilization element, and wherein an adjuvant is not coformulated or co-administered with the vaccine.

In other aspects the invention is a composition for or method of vaccinating a subject comprising administering to the subject a nucleic acid vaccine comprising one or more RNA polynucleotides having an open reading frame encoding a first antigenic polypeptide wherein a dosage of between 10 µg/kg and 400 µg/kg of the nucleic acid vaccine is administered to the subject. In some embodiments the dosage of the RNA polynucleotide is 1-5 µg, 5-10 µg, 10-15 µg, 15-20 µg, 10-25 µg, 20-25 µg, 20-50 µg, 30-50 µg, 40-50 µg, 40-60 µg, 60-80 µg, 60-100 µg, 50-100 µg, 80-120 µg, 40-120 µg, 40-150 µg, 50-150 µg, 50-200 µg, 80-200 µg, 100-200 µg, 120-250 µg, 150-250 µg, 180-280 µg, 200-300 µg, 50-300 µg, 80-300 µg, 100-300 µg, 40-300 µg, 50-350 µg, 100-350 µg, 200-350 µg, 300-350 µg, 320-400 µg, 40-380 µg, 40-100 µg, 100-400 µg, 200-400 µg, or 300-400 µg per dose. In some embodiments, the nucleic acid vaccine is administered to the subject by intradermal or intramuscular injection. In some embodiments, the nucleic acid vaccine is administered to the subject on day zero. In some embodiments, a second dose of the nucleic acid vaccine is administered to the subject on day twenty one.

In some embodiments, a dosage of 25 micrograms of the RNA polynucleotide is included in the nucleic acid vaccine administered to the subject. In some embodiments, a dosage of 100 micrograms of the RNA polynucleotide is included in the nucleic acid vaccine administered to the subject. In some embodiments, a dosage of 50 micrograms of the RNA polynucleotide is included in the nucleic acid vaccine administered to the subject. In some embodiments, a dosage of 75 micrograms of the RNA polynucleotide is included in the nucleic acid vaccine administered to the subject. In some embodiments, a dosage of 150 micrograms of the RNA polynucleotide is included in the nucleic acid vaccine administered to the subject. In some embodiments, a dosage of 400 micrograms of the RNA polynucleotide is included in the nucleic acid vaccine administered to the subject. In some embodiments, a dosage of 200 micrograms of the RNA polynucleotide is included in the nucleic acid vaccine administered to the subject. In some embodiments, the RNA polynucleotide accumulates at a 100 fold higher level in the local lymph node in comparison with the distal lymph node.

In other embodiments the nucleic acid vaccine is chemically modified and in other embodiments the nucleic acid vaccine is not chemically modified.

Aspects of the invention provide a nucleic acid vaccine comprising one or more RNA polynucleotides having an open reading frame encoding a first antigenic polypeptide, wherein the RNA polynucleotide does not include a stabilization element, and a pharmaceutically acceptable carrier or excipient, wherein an adjuvant is not included in the vaccine. In some embodiments, the stabilization element is a histone stem-loop. In some embodiments, the stabilization element is a nucleic acid sequence having increased GC content relative to wild type sequence.

Aspects of the invention provide nucleic acid vaccines comprising one or more RNA polynucleotides having an open reading frame encoding a first antigenic polypeptide, wherein the RNA polynucleotide is present in the formulation for in vivo administration to a host, which confers an antibody titer superior to the criterion for seroprotection for the first antigen for an acceptable percentage of human subjects. In some embodiments, the antibody titer produced by the mRNA vaccines of the invention is a neutralizing antibody titer. In some embodiments the neutralizing antibody titer is greater than a protein vaccine. In other embodiments the neutralizing antibody titer produced by the mRNA vaccines of the invention is greater than an adjuvanted protein vaccine. In yet other embodiments the neutralizing antibody titer produced by the mRNA vaccines of the invention is 1,000-10,000, 1,200-10,000, 1,400-10,000, 1,500-10,000, 1,000-5,000, 1,000-4,000, 1,800-10,000, 2000-10,000, 2,000-5,000, 2,000-3,000, 2,000-4,000, 3,000-5,000, 3,000-4,000, or 2,000-2,500. A neutralization titer is typically expressed as the highest serum dilution required to achieve a 50% reduction in the number of plaques.

Also provided are nucleic acid vaccines comprising one or more RNA polynucleotides having an open reading frame encoding a first antigenic polypeptide, wherein the RNA polynucleotide is present in a formulation for in vivo administration to a host for eliciting a longer lasting high antibody titer than an antibody titer elicited by an mRNA vaccine having a stabilizing element or formulated with an adjuvant and encoding the first antigenic polypeptide. In some embodiments, the RNA polynucleotide is formulated to produce neutralizing antibodies within one week of a single administration. In some embodiments, the adjuvant is selected from a cationic peptide and an immunostimulatory nucleic acid. In some embodiments, the cationic peptide is protamine.

Aspects provide nucleic acid vaccines comprising one or more RNA polynucleotides having an open reading frame comprising at least one chemical modification or optionally no modified nucleotides, the open reading frame encoding a first antigenic polypeptide, wherein the RNA polynucleotide is present in the formulation for in vivo administration to a host such that the level of antigen expression in the host significantly exceeds a level of antigen expression produced by an mRNA vaccine having a stabilizing element or formulated with an adjuvant and encoding the first antigenic polypeptide.

Other aspects provide nucleic acid vaccines comprising one or more RNA polynucleotides having an open reading frame comprising at least one chemical modification or optionally no modified nucleotides, the open reading frame encoding a first antigenic polypeptide, wherein the vaccine has at least 10 fold less RNA polynucleotide than is required for an unmodified mRNA vaccine to produce an equivalent antibody titer. In some embodiments, the RNA polynucleotide is present in a dosage of 25-100 micrograms.

Aspects of the invention also provide a unit of use vaccine, comprising between 10 ug and 400 ug of one or more RNA polynucleotides having an open reading frame comprising at least one chemical modification or optionally no modified nucleotides, the open reading frame encoding a first antigenic polypeptide, and a pharmaceutically acceptable carrier or excipient, formulated for delivery to a human subject. In some embodiments, the vaccine further comprises a cationic lipid nanoparticle.

Aspects of the invention provide methods of creating, maintaining or restoring antigenic memory to a virus strain in an individual or population of individuals comprising administering to said individual or population an antigenic memory booster nucleic acid vaccine comprising (a) at least one RNA polynucleotide, said polynucleotide comprising at least one chemical modification or optionally no modified nucleotides and two or more codon-optimized open reading frames, said open reading frames encoding a set of reference antigenic polypeptides, and (b) optionally a pharmaceutically acceptable carrier or excipient. In some embodiments, the vaccine is administered to the individual via a route selected from the group consisting of intramuscular administration, intradermal administration and subcutaneous administration. In some embodiments, the administering step comprises contacting a muscle tissue of the subject with a device suitable for injection of the composition. In some embodiments, the administering step comprises contacting a muscle tissue of the subject with a device suitable for injection of the composition in combination with electroporation.

Aspects of the invention provide methods of vaccinating a subject comprising administering to the subject a single dosage of between 25 ug/kg and 400 ug/kg of a nucleic acid vaccine comprising one or more RNA polynucleotides having an open reading frame encoding a first antigenic polypeptide in an effective amount to vaccinate the subject.

Other aspects provide nucleic acid vaccines comprising one or more RNA polynucleotides having an open reading frame comprising at least one chemical modification, the open reading frame encoding a first antigenic polypeptide, wherein the vaccine has at least 10 fold less RNA polynucleotide than is required for an unmodified mRNA vaccine to produce an equivalent antibody titer. In some embodiments, the RNA polynucleotide is present in a dosage of 25-100 micrograms.

Other aspects provide nucleic acid vaccines comprising an LNP formulated RNA polynucleotide having an open reading frame comprising no nucleotide modifications (unmodified), the open reading frame encoding a first antigenic polypeptide, wherein the vaccine has at least 10 fold less RNA polynucleotide than is required for an unmodified mRNA vaccine not formulated in a LNP to produce an equivalent antibody titer. In some embodiments, the RNA polynucleotide is present in a dosage of 25-100 micrograms.

The data presented in the Examples demonstrate significant enhanced immune responses using the formulations of the invention. Both chemically modified and unmodified RNA vaccines are useful according to the invention. Surprisingly, in contrast to prior art reports that it was preferable to use chemically unmodified mRNA formulated in a carrier for the production of vaccines, it is described herein that chemically modified mRNA-LNP vaccines required a much lower effective mRNA dose than unmodified mRNA, i.e., tenfold less than unmodified mRNA when formulated in carriers other than LNP. Both the chemically modified and unmodified RNA vaccines of the invention produce better immune responses than mRNA vaccines formulated in a different lipid carrier.

In other aspects the invention encompasses a method of treating an elderly subject age 60 years or older comprising administering to the subject a nucleic acid vaccine comprising one or more RNA polynucleotides having an open reading frame encoding a virus antigenic polypeptide in an effective amount to vaccinate the subject.

In other aspects the invention encompasses a method of treating a young subject age 17 years or younger comprising administering to the subject a nucleic acid vaccine comprising one or more RNA polynucleotides having an open reading frame encoding a virus antigenic polypeptide in an effective amount to vaccinate the subject.

In other aspects the invention encompasses a method of treating an adult subject comprising administering to the subject a nucleic acid vaccine comprising one or more RNA polynucleotides having an open reading frame encoding a virus antigenic polypeptide in an effective amount to vaccinate the subject.

In some aspects the invention is a method of vaccinating a subject with a combination vaccine including at least two nucleic acid sequences encoding antigens wherein the dosage for the vaccine is a combined therapeutic dosage wherein the dosage of each individual nucleic acid encoding an antigen is a sub therapeutic dosage. In some embodiments, the combined dosage is 25 micrograms of the RNA polynucleotide in the nucleic acid vaccine administered to the subject. In some embodiments, the combined dosage is 100 micrograms of the RNA polynucleotide in the nucleic acid vaccine administered to the subject. In some embodiments the combined dosage is 50 micrograms of the RNA polynucleotide in the nucleic acid vaccine administered to the subject. In some embodiments, the combined dosage is 75 micrograms of the RNA polynucleotide in the nucleic acid vaccine administered to the subject. In some embodiments, the combined dosage is 150 micrograms of the RNA polynucleotide in the nucleic acid vaccine administered to the subject. In some embodiments, the combined dosage is 400 micrograms of the RNA polynucleotide in the nucleic acid vaccine administered to the subject. In some embodiments, the sub therapeutic dosage of each individual nucleic acid encoding an antigen is 1, 2, 3, 4, 5, 6, 7, 8, 9, 10, 11, 12, 13, 14, 15, 16, 17, 18, 19, or 20 micrograms. In other embodiments the nucleic acid vaccine is chemically modified and in other embodiments the nucleic acid vaccine is not chemically modified.

The RNA polynucleotide is one of SEQ ID NO: 1-12, 18-21, 30-39, 48-51, 55-58, 56, 65-96, 118-155, 223-256 or 376-401 and includes at least one chemical modification. In other embodiments the RNA polynucleotide is one of SEQ ID NO: 1-12, 18-21, 30-39, 48-51, 55-58, 56, 65-96, 118-155, 223-256 or 376-401 and does not include any nucleotide modifications, or is unmodified. In yet other embodiments the at least one RNA polynucleotide encodes an antigenic protein of any of SEQ ID NO: 13-17, 22-29, 44-47, 52-54, 59-64, 97-117, 156-222, 469, 259-291 or 402-413 and includes at least one chemical modification. In other embodiments the RNA polynucleotide encodes an antigenic protein of any of SEQ ID NO: 13-17, 22-29, 44-47, 52-54, 59-64, 97-117, 156-222, 469, 259-291 or 402-413 and does not include any nucleotide modifications, or is unmodified.

In preferred aspects, vaccines of the invention (e.g., LNP-encapsulated mRNA vaccines) produce prophylactically- and/or therapeutically-efficacious levels, concentrations and/or titers of antigen-specific antibodies in the blood or serum of a vaccinated subject. As defined herein, the term antibody titer refers to the amount of antigen-specific antibody produces in s subject, e.g., a human subject. In exemplary embodiments, antibody titer is expressed as the inverse of the greatest dilution (in a serial dilution) that still gives a positive result. In exemplary embodiments, antibody titer is determined or measured by enzyme-linked immunosorbent assay (ELISA). In exemplary embodiments, antibody titer is determined or measured by neutralization assay, e.g., by microneutralization assay. In certain aspects, antibody titer measurement is expressed as a ratio, such as 1:40, 1:100, etc.

In exemplary embodiments of the invention, an efficacious vaccine produces an antibody titer of greater than 1:40, greater that 1:100, greater than 1:400, greater than 1:1000, greater than 1:2000, greater than 1:3000, greater than 1:4000, greater than 1:500, greater than 1:6000, greater than 1:7500, greater than 1:10000. In exemplary embodiments, the antibody titer is produced or reached by 10 days following vaccination, by 20 days following vaccination, by 30 days following vaccination, by 40 days following vaccination, or by 50 or more days following vaccination. In exemplary embodiments, the titer is produced or reached following a single dose of vaccine administered to the subject. In other embodiments, the titer is produced or reached following multiple doses, e.g., following a first and a second dose (e.g., a booster dose.)

In exemplary aspects of the invention, antigen-specific antibodies are measured in units of μg/ml or are measured in units of IU/L (International Units per liter) or mIU/ml (milli International Units per ml). In exemplary embodiments of the invention, an efficacious vaccine produces >0.5 ng/ml, >0.1 ng/ml, >0.2 ng/ml, >0.35 ng/ml, >0.5 ng/ml, >1 ng/ml, >2 ng/ml, >5 μg/ml or >10 ng/ml. In exemplary embodiments of the invention, an efficacious vaccine produces >10 mIU/ml, >20 mIU/ml, >50 mIU/ml, >100 mIU/ml, >200 mIU/ml, >500 mIU/ml or >1000 mIU/ml. In exemplary embodiments, the antibody level or concentration is produced or reached by 10 days following vaccination, by 20 days following vaccination, by 30 days following vaccination, by 40 days following vaccination, or by 50 or more days following vaccination. In exemplary embodiments, the level or concentration is produced or reached following a single dose of vaccine administered to the subject. In other embodiments, the level or concentration is produced or reached following multiple doses, e.g., following a first and a second dose (e.g., a booster dose.) In exemplary embodiments, antibody level or concentration is determined or measured by enzyme-linked immunosorbent assay (ELISA). In exemplary embodiments, antibody level or concentration is determined or measured by neutralization assay, e.g., by microneutralization assay.

The details of various embodiments of the disclosure are set forth in the description below. Other features, objects, and advantages of the disclosure will be apparent from the description and from the claims.

BRIEF DESCRIPTION OF THE DRAWINGS

FIG. 4 shows a bar graph of the data provided in FIG. 3.

FIG. 5 shows a reducing SDS-PAGE gel of Zika VLP.

FIGS. 8A-8C show Dengue Virus MHC I T cell epitopes. The sequences, from left to right correspond to SEQ ID NO: 365-366 (FIG. 8A), 367-368 (FIG. 8B), and 369-370 (FIG. 8C).

FIG. 12 is a schematic of a bone marrow/liver/thymus (BLT) mouse and data on human CD8 T cells stimulated with Dengue peptide epitope.

FIG. 16 is a graph showing the Mean Fluorescent Intensity (MFI) of antibody binding to DENV-1, 2, 3, and 4 prME epitopes presented on the cell surface.

FIG. 17A shows the immunization, challenge, and serum collection schedules. FIG. 17B shows the survival of the AG129 mice challenged with Dengue D2Y98P virus after being immunized with the indicated DENV mRNA vaccines. All immunized mice survived 11 days post infection, while the unimmunized (control) mice died. FIGS. 17C and 17D show the weight loss of the AG129 mice post infection. Vaccine 1, 7, 8, or 9 correspond to DENV vaccine construct 22, 21, 23, or 24 of the present disclosure, respectively.

FIGS. 19A-19I are graphs showing the results of a challenge study in AG129 mice. The challenge study design is shown in Table 46. FIGS. 19A-19F show the survival, weight loss, and heath score of the AG129 mice challenged with D2Y98P virus after being immunized with the DENV mRNA vaccine groups 1-12 in Table 46. FIGS. 19G-19I show the survival, weight loss, and heath score of the AG129 mice challenged with D2Y98P virus after being immunized with the DENV mRNA vaccine groups 13-19 in Table 46.

FIG. 20 shows CHIKV envelope protein detection of lysate in HeLa cells 16 hours post-transfection.

FIG. 27A shows the survival curve of mice groups 1-4 and 7-9 challenged on day 56 post immunization. FIG. 27B shows the survival curve of mice groups 10-16 challenged on day 112 post immunization. Survival curves were plotted as "percent survival" versus "days post infection." See also Table 63 for survival percentage.

FIG. 28A shows the weight change of mice groups 1-4 and 7-9 challenged on day 56 post immunization. FIG. 28B shows the weight changes of mice groups 10-16 challenged on day 112 post immunization. Initial weights were assessed on individual mice on study Day 0 and daily thereafter. The mean percent weights for each group compared to their percent weight on Day 0 (baseline) were plotted against "days post-infection". Error bars represent the standard deviation (SD).

FIG. 29A shows the health scores of mice groups 1-4 and 7-9 challenged on day 56 post immunization. FIG. 29B shows the health score of mice groups 10-16 challenged on day 112 post immunization. The mean health scores for each group were plotted against "days post infection" and error bars represent the SD. Mean health scores were calculated based on observations described in Table 51.

FIGS. 30A-30C are graphs showing the antibody titers measured by ELISA assays in the serum of AG129 mice (groups 1-4 and 7-9) 28 days post immunization with CHIKV mRNA vaccines. FIG. 30A shows the serum antibody titers against CHIKV E1 protein. FIG. 30B shows the serum antibody titers against CHIKV E2 protein. FIG. 30C shows the serum antibody titers against CHIKV lysate.

FIG. 31A shows the serum antibody titers against CHIKV E1 protein. FIG. 31B shows the serum antibody titers against CHIKV E2 protein. FIG. 31C shows the serum antibody titers against CHIKV lysate.

FIGS. 32A-32C are graphs showing the antibody titers measured by ELISA assays in the serum of AG129 mice (groups 10-16) 56 days post immunization with CHIKV mRNA vaccine. FIG. 32A shows the serum antibody titers against CHIKV E1 protein. FIG. 32B shows the serum antibody titers against CHIKV E2 protein. FIG. 32C shows the serum antibody titers against CHIKV lysate.

FIGS. 33A-33C are graphs showing the antibody titers measured by ELISA assays in the serum of AG129 mice (groups 10-16) 112 days post immunization with CHIKV mRNA vaccine. FIG. 33A shows the serum antibody titers against CHIKV E1 protein. FIG. 33B shows the serum antibody titers against CHIKV E2 protein. FIG. 33C shows the serum antibody titers against CHIKV lysate.

FIG. 34 shows a set of graphs depicting results of an ELISA assay to identify the amount of antibodies produced in AG129 mice in response to vaccination with mRNA encoding secreted CHIKV E1 structural protein, secreted CHIKV E2 structural protein, or CHIKV full structural polyprotein C-E3-E2-6k-E1 at a dose of 10 µg or 2 µg at 28 days post immunization.

FIG. 35 shows a set of graphs depicting results of an ELISA assay to identify the amount of antibodies produced in AG129 mice in response to vaccination with mRNA encoding secreted CHIKV E1 structural protein, secreted CHIKV E2 structural protein, or CHIKV full structural polyprotein C-E3-E2-6k-E1 at a dose of 10 µg or 2 µg at 28 days post immunization. The two panels depict different studies.

FIG. 40 shows a set of graphs depicting amount of neutralizing antibody produced in A129 mice in response to vaccination with mRNA encoding CHIKV full structural polyprotein C-E3-E2-6k-E1 at a dose of 10 µg, 2 µg, or 0.4 µg at 56 days post immunization against three different strains of CHIKV, African-Senegal (left panel), La Reunion (middle panel) and CDC CAR (right panel).

FIG. 46 shows a set of graphs depicting binding antibody titers against CHIKV lysate (upper graph) and neutralizing titers against 37997 CHIKV. The vaccine induces a robust antibody response in non-human primates (NHPs).

DETAILED DESCRIPTION

Figure 1:
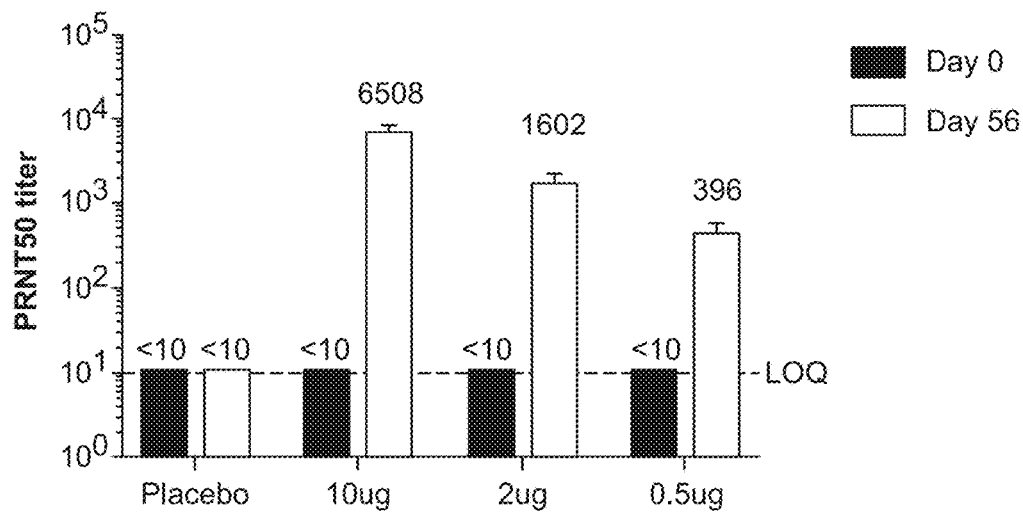
FIG. 1 shows data from an immunogenicity experiment in which mice were immunized with JEV prME mRNA vaccine. The data show that immunization of mice with JEV mRNA vaccine at 10 μg, 2 μg and 0.5 μg doses produces neutralizing antibodies measured between $10^2$ to $10^4$ PRNT50 titers.

Vaccines containing antigens from more than one pathogenic organism within a single dose are referred to as "multivalent" or "combination" vaccines. While various combination vaccines have been approved for human use in several countries, including trivalent vaccines for protecting against diphtheria, tetanus and pertussis ("DTP" vaccines) and trivalent vaccines for protecting against measles, mumps and rubella ("MMR" vaccines), combination vaccines are more complex and are associated with more problems than monovalent vaccines. For instance, current combination vaccines can include relatively high amounts of aluminum salts as adjuvants which causes concern to some patients despite empirical safety studies. Additionally, the well-documented phenomenon of antigenic competition (or interference) complicates the development of multi-component vaccines. Antigenic interference refers to the observation that administering multiple antigens often results in a diminished response to certain antigens relative to the immune response observed when such antigens are administered individually. The combination RNA vaccines of the invention can be designed to encode two, three, four, five or more, antigens against multiple pathogenic organisms, while avoiding a number of the problems associated with traditional combination vaccines.

Travelers facing a particular geographic viral threat would also benefit from vaccination with a combination vaccine of the invention. The traveler's vaccine may be tailored based on the prevalence of particular viral diseases in the destination location. For instance a combination vaccine including WNV, SINV, VEEV, and EEEV would be particularly beneficial.

Embodiments of the present disclosure provide RNA (e.g., mRNA) vaccines that are useful for vaccinating against multiple pathogens. The combination vaccines of the present disclosure encode antigens from multiple pathogens (e.g., bacteria, arboviruses, alphaviruses and flaviviruses), including but not limited to *Plasmodium* (e.g., *P. falciparum, P. vivax, P. Malariae* and/or *P. ovale*), Japanese Encephalitis Virus (JEV), West Nile Virus (WNV), Eastern Equine Encephalitis (EEEV), Venezuelan Equine Encephalitis Virus (VEEV), Sindbis Virus (SINV), Chikungunya Virus (CHIKV), Dengue Virus (DENV), Zika Virus (ZIKV) and/or Yellow Fever Virus (YFV) antigenic polypeptide.

Thus, the present disclosure provides, in some embodiments, vaccines that comprise RNA (e.g., mRNA) polynucleotides encoding a Malaria (e.g., *P. falciparum, P. vivax, P. Malariae* and/or *P. ovale*), JEV, WNV, EEEV, VEEV, SINV, CHIKV, DENV, ZIKV and/or YFV antigenic polypeptide. The present disclosure also provides, in some embodiments, combination vaccines that comprise at least one RNA (e.g., mRNA) polynucleotide encoding at least two antigenic polypeptides selected from Malaria (e.g., *P. falciparum, P. vivax, P. Malariae* and/or *P. ovale*), JEV, WNV, EEEV, VEEV, SINV, CHIKV, DENV, ZIKV and YFV antigenic polypeptides. Also provided herein are methods of administering the RNA (e.g., mRNA) vaccines, methods of producing the RNA (e.g., mRNA) vaccines, compositions (e.g., pharmaceutical compositions) comprising the RNA (e.g., mRNA) vaccines, and nucleic acids (e.g., DNA) encoding the RNA (e.g., mRNA) vaccines. In some embodiments, a RNA (e.g., mRNA) vaccine comprises an adjuvant, such as a flagellin adjuvant, as provided herein.

The RNA (e.g., mRNA) vaccines (e.g., Malaria (e.g., *P. falciparum, P. vivax, P. Malariae* and/or *P. ovale*), JEV, WNV, EEEV, VEEV, SINV, CHIKV, DENV, ZIKV and/or YFV RNA vaccines), in some embodiments, may be used to induce a balanced immune response, comprising both cellular and humoral immunity, without many of the risks associated with DNA vaccination.

The entire contents of International Application No. PCT/US2015/02740 is incorporated herein by reference.

Malaria

Malaria is an infectious disease caused by protozoan parasites from the *Plasmodium* family. *Anopheles* mosquitoes transmit Malaria, and they must have been infected through a previous blood meal taken from an infected person. When a mosquito bites an infected person, a small amount of blood is taken in and contains microscopic Malaria parasites. There are four main types of Malaria which infect humans: *Plasmodium falciparum, P. vivax, P. Malariae* and *P. ovale*. *Falciparum* Malaria is the most deadly type. Many Malaria parasites are now immune to the most common drugs used to treat the disease.

Embodiments of the present disclosure provide RNA (e.g., mRNA) vaccines that include polynucleotide encoding a *Plasmodium* antigen. Malaria parasites are microorganisms that belong to the genus *Plasmodium*. There are more than 100 species of *Plasmodium*, which can infect many animal species such as reptiles, birds, and various mammals Four species of *Plasmodium* have long been recognized to infect humans in nature, including *P. falciparum, P. vivax, P. Malariae* and *P. ovale*. In addition, there is one species that naturally infects macaques which has recently been recognized to be a cause of zoonotic Malaria in humans.

Malaria RNA (e.g., mRNA) vaccines, as provided herein may be used to induce a balanced immune response, comprising both cellular and humoral immunity, without many of the risks associated with DNA vaccination.

*P. falciparum* infects humans and is found worldwide in tropical and subtropical areas. It is estimated that every year approximately 1 million people are killed by *P. falciparum*, especially in Africa where this species predominates. *P. falciparum* can cause severe Malaria because it multiplies rapidly in the blood, and can thus cause severe blood loss (anemia). In addition, the infected parasites can clog small blood vessels. When this occurs in the brain, cerebral Malaria results, a complication that can be fatal. Some embodiments of the present disclosure provide Malaria vaccines that include at least one RNA (e.g., mRNA) polynucleotide having an open reading frame encoding at least one *P. falciparum* antigenic polypeptide or an immunogenic fragment thereof (e.g., an immunogenic fragment capable of raising an immune response to *P. falciparum*).

*P. vivax* infects humans and is found mostly in Asia, Latin America, and in some parts of Africa. Because of the population densities, especially in Asia, it is probably the most prevalent human Malaria parasite. *P. vivax* (as well as *P. ovale*) has dormant liver stages ("hypnozoites") that can activate and invade the blood ("relapse") several months or years after the infecting mosquito bite. Some embodiments of the present disclosure provide Malaria vaccines that include at least RNA (e.g., mRNA) polynucleotide having an open reading frame encoding at least one *P. vivax* antigenic polypeptide or an immunogenic fragment thereof (e.g., an immunogenic fragment capable of raising an immune response to *P. vivax*).

*P. ovale* infects humans and is found mostly in Africa (especially West Africa) and the islands of the western Pacific. It is biologically and morphologically very similar to *P. vivax*. However, differently from *P. vivax*, it can infect individuals who are negative for the Duffy blood group, which is the case for many residents of sub-Saharan Africa. This explains the greater prevalence of *P. ovale* (rather than *P. vivax*) in most of Africa. Some embodiments of the present disclosure provide Malaria vaccines that include at least one RNA (e.g., mRNA) polynucleotide having an open reading frame encoding at least one *P. ovale* antigenic polypeptide or an immunogenic fragment thereof (e.g., an immunogenic fragment capable of raising an immune response to *P. ovale*).

*P. Malariae* infects humans and is found worldwide. It is the only human Malaria parasite species that has a quartan cycle (three-day cycle). The three other species that infect human have a tertian, two-day cycle. If untreated, *P. Malariae* causes a long-lasting, chronic infection that in some cases can last a lifetime. In some chronically infected patients *P. Malariae* can cause serious complications such as the nephrotic syndrome. Some embodiments of the present disclosure provide Malaria vaccines that include at least one RNA (e.g., mRNA) polynucleotide having an open reading frame encoding at least one P. *Malariae* antigenic polypeptide or an immunogenic fragment thereof (e.g., an immunogenic fragment capable of raising an immune response to *P. Malariae*).

*P. knowlesi* is found throughout Southeast Asia as a natural pathogen of long-tailed and pig-tailed macaques. It has recently been shown to be a significant cause of zoonotic Malaria in that region, particularly in Malaysia. *P. knowlesi* has a 24-hour replication cycle and so can rapidly progress from an uncomplicated to a severe infection; fatal cases have been reported.

In some embodiments, an antigenic polypeptide is any antigen that is expressed on the sporozoite or other pre-erythrocytic stage of a *Plasmodium* parasite, such as the liver stage. For example, an antigenic polypeptide may be a circurnsporozoite (CS) protein, liver stage antigen-1 (LSA1) (see, e.g., WO2004/044167 and Cummings J F et al. *Vaccine*

2010; 28:5135-44, incorporated herein by reference), liver stage antigen-3 (LSA-3) (see, e.g., EP 0 570 489 and EP 0 833 917, incorporated herein by reference), Pfs 16 kD (see, e.g., WO 91/18922 and EP 597 843), Exported antigen-1 (Exp-1) (described for example in Meraldi et al. *Parasite Immunol* 2002; 24(3):141, incorporated herein by reference), sporozoite-threonine-asparagine-rich protein (STARP), sporozoite and liver stage antigen (SALSA), thrombospondin related anonymous protein (TRAP) (see, e.g., WO 90/01496, WO 91/11516 and WO 92/11868, incorporated herein by reference) and apical merozoite antigen-1 (AMA1) (see, e.g., EP 0 372 019 and Remargue E J et al. *Trends in Parasitology* 2007; 24(2):74-84, incorporated herein by reference) which has recently been shown to be present at the liver stage (in addition to the erythrocytic stage), and merozoite surface protein-1 (MSP1) (see, e.g., Reed Z H et al. *Vaccine* 2009; 27:1651-60, incorporated herein by reference). An antigenic polypeptide may be the entire protein, an immunogenic fragment thereof, or a derivative thereof of any of the foregoing antigens. Immunogenic fragments of Malaria antigens are known, including, for example, the ectodomain from AMA1 (see, e.g., WO 02/077195, incorporated herein by reference). Derivatives include, for example, fusions with other proteins that may be Malaria proteins or non-Malaria proteins, such as HBsAg. Derivatives of the present disclosure are capable of raising an immune response against the native antigen.

The sporozoite stage of *Plasmodium* (e.g., *P. falciparum* or *P. vivax*) is a potential target of a Malaria vaccine. The major surface protein of the sporozoite is circumsporozoite protein (CS protein). The *Plasmodium* circumsporozoite protein (CS) is expressed during the sporozoite and early liver stages of parasitic infection. This protein is involved in the adhesion of the sporozoite to the hepatocyte and invasion of the hepatocyte. Anti-CS antibodies inhibit parasite invasion and are also associated with a reduced risk of clinical Malaria in some studies. Antibodies raised through immunization with only the conserved Asparagine-Alanine-Asparagine-Proline (NAND) amino acid repeat sequence, the immunodominant B-cell epitope from *P. falciparum* CS, are capable of blocking sporozoite invasion of hepatocytes.

CS protein has been cloned, expressed and sequenced for a variety of strains, for example for *P. falciparum* the NF54 strain, clone 3D7 (Caspers et al. *Parasitol* 1989; 35:185-190, incorporated herein by reference). The protein from strain 3D7 has a central immunodominant repeat region comprising a tetrapeptide Asn-Ala-Asn-Pro (SEQ ID NO: 434) repeated 40 times and interspersed with four minor repeats of the tetrapeptide Asn-Val-Asp-Pro (SEQ ID NO: 435). In other strains, the number of major and minor repeats as well as their relative position varies. This central portion is flanked by an N and C terminal portion composed of non-repetitive amino acid sequences designated as the repeatless portion of the CS protein.

Some embodiments of the present disclosure provide Malaria vaccines that include at least one RNA (e.g., mRNA) polynucleotide having an open reading frame encoding *Plasmodium* CS protein or an immunogenic fragment thereof (e.g., an immunogenic fragment capable of raising an immune response to *Plasmodium*).

Liver Stage Antigen-1 (LSA1), expressed during *Plasmodium falciparum* hepatic schizogony is highly conserved, is abundantly expressed from early through late schizogony, presumably allowing time for both circulating and memory-recalled effector cells to infiltrate the liver and exert their effector function, and it is possible that high titer antibody could act upon the cloud of flocculent liver stage antigen enveloping hepatic merozoites to impede the latter's emergence and subsequent invasion of erythrocytes. LSA1 is a 230 kDa protein, with a large central repeat region (over 80 repeats of 17 amino acids each) flanked by two highly conserved N- and C-terminal regions, known to contain B cell and CD4+ and CD8$^+$ T cell epitopes.

Some embodiments of the present disclosure provide Malaria vaccines that include at least one RNA (e.g., mRNA) polynucleotide having an open reading frame encoding *Plasmodium* LSA1 or an immunogenic fragment thereof (e.g., an immunogenic fragment capable of raising an immune response to *Plasmodium*). In some embodiments, Malaria vaccines include at least one RNA (e.g., mRNA) polynucleotide having an open reading frame encoding a recombinant protein with full-length C- and N-terminal flanking domains and two of the 17 amino acid repeats from the central repeat region, referred to as "LSA-NRC."

Present on the surface of all known *Plasmodium* spp., merozoite surface protein 1 (MSP1) is a polypeptide of 190-230 kDa that undergoes processing during schizont rupture to produce at least four distinct fragments (83, 28-30, 38-45 and 42 kDa). Further cleavage of the carboxy-terminal 42-kDa (MSP142) fragment yields a 19-kDa fragment (MSP119), in a process that appears to be critical for merozoite invasion. Both MSP$_{142}$ and MSP$_{119}$ regions of *P. falciparum* are encompassed by the present disclosure.

Thus, in some embodiments, Malaria vaccines include at least one RNA (e.g., mRNA) polynucleotide having an open reading frame encoding *Plasmodium* MSP1 or an immunogenic fragment thereof (e.g., an immunogenic fragment capable of raising an immune response to *Plasmodium*).

In some embodiments, Malaria vaccines include at least one RNA (e.g., mRNA) polynucleotide having an open reading frame encoding *Plasmodium* MSP1, MSP3 and AMA1.

Apical membrane antigen 1 (AMA1) is a micronemal protein of apicomplexan parasites that appears to be essential during the invasion of host cells. Immune responses to *Plasmodium* AMA1 can have parasite-inhibitory effects, both as measured in vitro and in animal challenge models. First identified as an invariant *Plasmodium knowlesi* merozoite surface antigen, AMA1 is believed to be unique to apicomplexan and derives from a single essential gene present in all *Plasmodium* species.

Some embodiments of the present disclosure provide Malaria vaccines that include at least one RNA (e.g., mRNA) polynucleotide having an open reading frame encoding *Plasmodium* AMA1 or an immunogenic fragment thereof (e.g., an immunogenic fragment capable of raising an immune response to *Plasmodium*).

Japanese Encephalitis Virus (JEV)

Japanese encephalitis virus (JEV), a mosquito-borne *flavivirus*, is a common cause of encephalitis in Asia. Japanese encephalitis (JE) occurs throughout most of Asia and parts of the western Pacific. Among an estimated 35,000-50,000 annual cases, approximately 20%-30% of patients die, and 30%-50% of survivors have neurologic or psychiatric sequelae. In endemic countries, JE is primarily a disease of children. However, travel-associated JE, although rare, can occur in a wide portion of the population. JEV is transmitted in an enzootic cycle between mosquitoes and amplifying vertebrate hosts, primarily pigs and wading birds. JEV is transmitted to humans through the bite of an infected mosquito, primarily in rural agricultural areas. In most temperate areas of Asia, JEV transmission is seasonal, and substantial epidemics can occur.

Vaccines available for use against JEV infection include live virus inactivated by such methods as formalin treatment, as well as attenuated virus (Tsai et al., in Vaccines (Plotkin, ed.) W.B. Saunders, Philadelphia, Pa., 1994, pp. 671-713). Whole virus vaccines, although effective, do have certain problems and/or disadvantages. The viruses are cultivated in mouse brain or in cell culture using mammalian cells as the host. Such culture methods are cumbersome and expensive.

Embodiments of the present disclosure provide RNA (e.g., mRNA) vaccines that include polynucleotide encoding a JEV antigen. JEV is a small-enveloped virus with a single-stranded, plus-sense RNA genome, consisting of a single open reading frame that codes for a large polyprotein which is co- and post-translationally cleaved into three structural (capsid, C; pre-membrane, prM; and envelope, E) and seven non-structural proteins (NS1, NS2A, NS2B, NS3, NS4A, NS4B and NS5). The RNA genome of JEV has a type I cap structure at its 5'-terminus but lacks a poly(A) tail at its 3' terminus. E protein is involved in a number of important functions related to virus infection such as receptor binding and membrane fusion. E protein has been used to raise antibodies that neutralize virus activity in vitro as well as in vivo. Additionally, sub-viral particles consisting of only the prM and the E proteins were highly effective in generating protective immune response in mice against JEV. The ability of various JEV structural and non-structural proteins to produce an immune response has been examined. (Chen, H. W., et al., 1999. *J. Virol.* 73:10137-10145.) In view of these and other studies it has been concluded that the E protein is an important protein for inducing protective immunity against JEV.

The full-length E protein is membrane anchored Immunogenic fragments of the E protein can be generated by removing the anchor signal. For instance, truncated Ea protein wherein a 102-amino acid hydrophobic sequence has been removed from the C-terminus of the protein to generate a 398-amino acid Es protein for immunogenic antigenic fragments. Other immunogenic fragments include a secretory form of E protein, as opposed to the anchored protein. Thus immunogenic fragments include the truncated E protein and the secretory envelope protein (Es) of JEV. JEV antigens may also include one or more non-structural proteins selected from NS1, NS2A, NS2B, NS3, NS4A, NS4B and NS5.

Since the envelope (most external portion of a JEV particle) is the first to encounter target cells, the present disclosure encompasses antigenic polypeptides associated with the envelope as immunogenic agents. In brief, surface and membrane proteins E, Es, capsid and prM—as single antigens or in combination with or without adjuvants may be used as JEV vaccine antigens.

In some embodiments, JEV vaccines comprise RNA (e.g., mRNA) encoding JEV E antigenic polypeptides or immunogenic fragments thereof.

In some embodiments, JEV vaccines comprise RNA (e.g., mRNA) encoding JEV Es antigenic polypeptides or immunogenic fragments thereof.

In some embodiments, JEV vaccines comprise RNA (e.g., mRNA) encoding JEV capsid antigenic polypeptides or immunogenic fragments thereof.

In some embodiments, JEV vaccines comprise RNA (e.g., mRNA) encoding JEV prM antigenic polypeptides or immunogenic fragments thereof.

In some embodiments, JEV vaccines comprise RNA (e.g., mRNA) encoding JEV NS1 antigenic polypeptides or immunogenic fragments thereof.

In some embodiments, JEV vaccines comprise RNA (e.g., mRNA) encoding JEV antigenic polypeptides having at least 80%, 85%, 90%, 92%, 95%, 96%, 97%, 98% or 99% identity with JEV E protein and has receptor binding and/or membrane fusion activity.

In some embodiments, JEV vaccines comprise RNA (e.g., mRNA) encoding JEV antigenic polypeptides having at least 80%, 85%, 90%, 92%, 95%, 96%, 97%, 98% or 99% identity with JEV Es protein and has receptor binding and/or membrane fusion activity.

In some embodiments, JEV vaccines comprise RNA (e.g., mRNA) encoding JEV antigenic polypeptides having at least 80%, 85%, 90%, 92%, 95%, 96%, 97%, 98% or 99% identity with JEV capsid protein having capsid activity.

In some embodiments, JEV vaccines comprise RNA (e.g., mRNA) encoding JEV antigenic polypeptides having at least 80%, 85%, 90%, 92%, 95%, 96%, 97%, 98% or 99% identity with JEV prM protein and has activity of an immature virion.

In some embodiments, JEV vaccines comprise RNA (e.g., mRNA) encoding JEV antigenic polypeptides having at least 80%, 85%, 90%, 92%, 95%, 96%, 97%, 98% or 99% identity with JEV NS1 protein and has viral replication and pathogenicity activity.

JEV RNA vaccines, as provided herein may be used to induce a balanced immune response, comprising both cellular and humoral immunity, without many of the risks associated with DNA vaccination.

West Nile Virus (WNV), Eastern Equine Encephalitis (EEEV), Venezuelan Equine Encephalitis Virus (VEEV), and Sindbis Virus (SINV)

WNV was first isolated in the West Nile region of Uganda, Africa, and belongs to the Flaviviridae family *falvivirus* genus. The structure of virus particles consists of a spherical structure wherein a capsid protein (C protein) is bonded to one (+) chain RNA virus gene, and a lipid bilayer membrane surrounding the spherical structure. The lipid membrane includes two kinds of proteins: envelope protein (E protein) and membrane protein (M protein). M protein is produced as a precursor prM protein and cleaved with a protease called furin to become a mature protein. West Nile virus (WNV) is an important mosquito transmitted virus which is now native to the U.S.

West Nile fever is a systemic acute fever disease caused by infection with WNV. Occasionally, the virus invades and grows in the central nervous system to cause lethal brain meningitis. WNV is widely distributed in Africa, Middle East, part of Europe, Russia, India, and Indonesia. The virus is maintained and propagated by an infection ring. The West Nile fever virus is transmitted to birds and mammals by the bites of certain mosquitoes (e.g., *Culex, Aedes, Anopheles*). Direct transmission may happen from WNV infected subject to healthy subject by oral transmission (prey and transmission through colostrum) and blood/organ vectored transmission. Humans, horses and domestic animals are hosts. Recently, WNV invaded and was indigenized in the US and has expanded since then. A prevalent US strain is West Nile virus NY99-flamingo382-99 strain (Lanciotti, R. S. et al., *Science*, 286: 2333-2337, 1999) (GenBank Accession No. AF196835).

The WNV antigens in the combination RNA vaccine may be derived from a particular WNV strain, such as NY99 or KEN-3829 or any other strain. Additional WNV strains are known in the art. West Nile virus antigens include the following proteins and polyproteins: C (capsid), E (envelope), M (membrane), prM (Pre-membrane), NS2A, NS2B, NS3 prM-E, M-E, prM-M, prM-M-E, and NS2A-NS2B-NS3.

Eastern equine encephalitis virus (EEEV), Western equine encephalitis virus (WEEV), and Venezuelan equine encephalitis virus (VEEV) are members of the Alphavirus genus of the family Togaviridae. The genus is comprised of at least 27 different arthropod-borne RNA viruses that are found throughout much of the world. The viruses normally circulate among avian or rodent hosts through the feeding activities of a variety of mosquitoes.

EEEV causes encephalitis in humans and equines in epidemic proportions. However, EEEV causes the most severe of the arboviral encephalitides in humans, with high mortality and severe neurological sequelae in survivors (Fields Virology, 4.sup.th Ed., Chapter 30 Alphaviruses, [2002] 917-962). The virus is known to be focally endemic along much of the Atlantic and Gulf Coasts of North America. It has also been found in southern Canada, the Caribbean, Central America, the eastern part of Mexico and in large sections of South America. Inland foci exist in the Great Lakes region and South Dakota in the U.S. as well as the Amazon Basin.

The current EEEV vaccine for veterinary applications in the U.S. is a formalin-inactivated whole virus preparation derived from the PE-6 strain (Bartelloni, et al. [1970] *Am J. Trop Med Hyg.* 19:123-126; Marie, et al. [1970] *Am J Trop Med Hyg.* 19:119-122). Currently there is no human vaccine. The inactivated veterinary vaccine is poorly immunogenic, requires multiple inoculations with frequent boosters and generally results in immunity of short duration.

EEEV, SINV, JEV, and CHIKV all have single-stranded, positive sense RNA genomes. A portion of the genome encodes the viral structural proteins Capsid, E3, E2, 6K, and E1, each of which are derived by proteolytic cleavage of the product of a single open reading frame. The nucleocapsid (C) protein possesses autoproteotytic activity which cleaves the C protein from the precursor protein soon after the ribosome transits the junction between the C and E3 protein coding sequence. Subsequently, the envelope glycoproteins E2 and E1 are derived by proteolytic cleavage in association with intracellular membranes and form heterodimers. E2 initially appears in the infected cell as the precursor protein PE2, which consists of E3 and E2. After extensive glycosylation and transit through the endoplasmic reticulum and the Golgi apparatus, E3 is cleaved from E2 by the furin protease. Subsequently, the E2/E1 complex is transported to the cell surface where it is incorporated into virus budding from the plasma membrane. The envelope proteins play an important role in attachment and fusion to cells.

Sindbis Virus (SINV) is also a member of the Togaviridae family, in the alphavirus subfamily and is transmitted by mosquitoes. Sindbis fever is most common in South and East Africa, Egypt, Israel, Philippines and parts of Australia. The genome encodes four non-structural proteins at the 5' end and the capsid and two envelope proteins at the 3' end. The non-structural proteins are involved in genome replication and the production of new genomic RNA and a shorter sub-genomic RNA strand. The viruses assemble at the host cell surfaces and acquire their envelope through budding.

Yellow Fever Virus (YFV)

Along with other viruses in the Flaviviridae family, Yellow fever virus is enveloped and icosahedral with a non-segmented, single-stranded, positive sense RNA genome. It is most closely related to the Sepik virus and is one of the two viruses in clade VIII. In 1927, Yellow fever virus was the first human virus to be isolated. It is found in tropical areas of Africa and South America. YFV is believed to have originated in Africa and spread to South America through slave trades in the $17^{th}$ century. Since then, there have been Yellow fever outbreaks in the Americas, Africa and Europe. It is transmitted by mosquitoes and has been isolated from a number of species in the genus *Aedes* (e.g., *Aedes aegypti, Aedes africanus* or *Aedes albopictus*). Mosquitos of the genus *Haemagogus* and *Sabethes* can also serve as vectors. Studies show that the extrinsic incubation period in mosquitoes is about 10 days. Vertebrate hosts of the virus include monkeys and humans.

Forty-seven African and South American countries are either endemic for, or have regions that are endemic from, Yellow fever. It is estimated that in 2013 alone, there were 84,000 to 170,000 severe cases of yellow fever and 29,000 to 60,000 deaths associated with Yellow fever.

What is important is not only the number of cases but also the clinical manifestation of the cases. After YFV incubates in the body for about 6 days, symptoms including fever, muscle pain, backache, headache, loss of appetite, and nausea or vomiting are observed. In most cases, these symptoms disappear after about 4 days. In a small percentage of patients, a more toxic phase of the disease is observed within 24 hours of recovering from the initial symptoms. In this toxic phase, patients develop high fever, jaundice, dark urine and abdominal pain with vomiting. Half of the patients that enter the toxic phase die within 10 days.

In some embodiments, YFV vaccines comprise RNA (e.g., mRNA) encoding a YFV antigenic polypeptide having at least 95%, at least 96%, at least 97%, at least 98% or at least 99% identity with YFV polyprotein and having YFV polyprotein activity, respectively. The YFV polyprotein is cleaved into capsid, precursor membrane, envelope, and non-structural proteins (NS1, NS2A, NS2B, NS3, NS4A, NS4B, NS5).

A protein is considered to have YFV polyprotein activity if, for example, it facilitates the attachment of the viral envelope to host receptors, mediates internalization into the host cell, and aids in fusion of the virus membrane with the host's endosomal membrane.

Zika Virus (ZIKV)

Along with other viruses in the Flaviviridae family, Zika virus is enveloped and icosahedral with a non-segmented, single-stranded, positive sense RNA genome. It is most closely related to the Spondweni virus and is one of the two viruses in the Spondweni virus clade. The virus was first isolated in 1947 from a rhesus monkey in the Zika Forest of Uganda, Africa and was isolated for the first time from humans in 1968 in Nigeria. From 1951 through 1981, evidence of human infection was reported from other African countries such as Uganda, Tanzania, Egypt, Central African Republic, Sierra Leone and Gabon, as well as in parts of Asia including India, Malaysia, the Philippines, Thailand, Vietnam and Indonesia. It is transmitted by mosquitoes and has been isolated from a number of species in the genus *Aedes—Aedes aegypti, Aedes africanus, Aedes apicoargenteus, Aedes furcifer, Aedes luteocephalus* and *Aedes vitattus*. Studies show that the extrinsic incubation period in mosquitoes is about 10 days. The vertebrate hosts of the virus include monkeys and humans.

As of early 2016, the most widespread outbreak of Zika fever, caused by the Zika virus, is ongoing primarily in the Americas. The outbreak began in April 2015 in Brazil, and subsequently spread to other countries in South America, Central America, and the Caribbean.

The Zika virus was first linked with newborn microcephaly during the Brazil Zika virus outbreak. In 2015, there were 2,782 cases of microcephaly compared with 147 in 2014 and 167 in 2013. The Brazilian Health Ministry has reported 4783 cases of suspected microcephaly as of Jan. 30, 2016, an increase of more than 1000 cases from a week earlier. Confirmation of many of the recent cases is pending, and it is difficult to estimate how many cases went unreported before the recent awareness of the risk of virus infections.

What is important is not only the number of cases but also the clinical manifestation of the cases. Brazil is seeing severe cases of microcephaly, which are more likely to be paired with greater developmental delays. Most of what is being reported out of Brazil is microcephaly with other associated abnormalities. The potential consequence of this is the fact that there are likely to be subclinical cases where the neurological sequelae will only become evident as the children grow.

Zika virus has also been associated with an increase in a rare condition known as Guillain-Barré, where the infected individual becomes essentially paralyzed. During the Zika virus outbreak in French Polynesia, of the 74 patients which had had Zika symptoms, 42 were diagnosed with Guillain-Barré syndrome. In Brazil, 121 cases of neurological manifestations and Guillain-Barré syndrome (GBS) were reported, all cases with a history of Zika-like symptoms.

The design of preferred Zika vaccine mRNA constructs of the invention encode prME proteins from the Zika virus intended to produce significant immunogenicity. The open reading frame comprises a signal peptide (to optimize expression into the endoplasmic reticulum) followed by the Zika prME polyprotein sequence. The particular prME sequence used is from a Micronesian strain (2007) that most closely represents a consensus of contemporary strain prMEs. This construct has 99% prME sequence identity to the current Brazilian isolates.

Within the Zika family, there is a high level of homology within the prME sequence (>90%) across all strains so far isolated. The high degree of homology is also preserved when comparing the original isolates from 1947 to the more contemporary strains circulating in Brazil in 2015, suggesting that there is "drift" occurring from the original isolates. Furthermore, attenuated virus preparations have provided cross-immunization to all other strains tested, including Latin American/Asian, and African. Overall, this data suggests that cross-protection of all Zika strains is possible with a vaccine based on prME. In fact, the prM/M and E proteins of ZIKV have a very high level (99%) of sequence conservation between the currently circulating Asiatic and Brazilian viral strains.

The M and E proteins are on the surface of the viral particle. Neutralizing antibodies predominantly bind to the E protein, the preM/M protein functions as a chaperone for proper folding of E protein and prevent premature fusion of E protein within acidic compartments along the cellular secretory pathway.

Described herein are examples of ZIKV vaccine designs comprising mRNA encoding the both prM/M and E proteins or E protein alone. In some embodiments, the mRNA encodes an artificial signal peptide fused to prM protein fused to E protein. In some embodiments, the mRNA encodes an artificial signal peptide fused to E protein.

ZIKV vaccine constructs can encode the prME or E proteins from different strains, for example, Brazil_isolate_ZikaSPH2015 or ACD75819_Micronesia, having a signal peptide fused to the N-termini of the antigenic protein(s). In some embodiments, ZIKV vaccines comprise mRNAs encoding antigenic polypeptides having amino acid sequences of SEQ ID NO: 156-222 or 469.

Dengue Virus (DENV)

There is no specific treatment for DENV infection, and control of DENV by vaccination has proved elusive, in part, because the pathogenesis of DHF/DSS is not completely understood. While infection with one serotype confers lifelong homotypic immunity, it confers only short term (approximately three to six months) cross protection against heterotypic serotypes. Also, there is evidence that prior infection with one type can produce an antibody response that can intensify, or enhance, the course of disease during a subsequent infection with a different serotype. The possibility that vaccine components could elicit enhancing antibody responses, as opposed to protective responses, has been a major concern in designing and testing vaccines to protect against dengue infections. In late 2015 and early 2016, the first dengue vaccine, Dengvaxia (CYD-TDV) by Sanofi Pasteur, was registered in several countries for use in individuals 9-45 years of age living in endemic areas. Issues with the vaccine include (1) weak protection against DENV1 and DENV2 (<60% efficacy); (2) relative risk of dengue hospitalization among children <9 years old (7.5× higher than placebo); (3) immunogenicity not sustained after 1-2 years (implying the need for a $4^{th}$ dose booster); and (4) lowest efficacy against DENV2, which often causes more severe conditions. This latter point is a major weakness with the Dengvaxia vaccine, signaling the need of a new, more effective vaccine effective against DENV2. Other tetravalent live-attenuated vaccines are under development in phase II and phase III clinical trials, and other vaccine candidates (based on subunit, DNA and purified inactivated virus platforms) are at earlier stages of clinical development, although the ability of these vaccine candidates to provide broad serotype protection has not been demonstrated.

Embodiments of the present disclosure provide RNA (e.g., mRNA) vaccines that include at least one RNA polynucleotide encoding a Dengue virus (DENV) antigen. Dengue virus is a mosquito-borne (*Aedes aegypti/Aedes albopictus*) member of the family Flaviviridae (positive-sense, single-stranded RNA virus). The dengue virus genome encodes ten genes and is translated as a single polypeptide which is cut into ten proteins: the capsid, envelope, membrane, and nonstructural proteins (NS1, NS2A, NS2B, NS3, SN4A, NS4B, and NS5 proteins). The virus' main antigen is DENV envelope (E) protein, which is a component of the viral surface and is thought to facilitate the binding of the virus to cellular receptors (Heinz et al., *Virology.* 1983, 126:525). There are four similar but distinct serotypes of dengue virus (DENV-1, DENV-2, DENV-3, DENV-4, and DENV-5), which result annually in an estimated 50-100 million cases of dengue fever and 500,000 cases of the more severe dengue hemorrhagic fever/dengue shock syndrome (DHF/DSS) (Gubler et al., *Adv Virus Res.* 1999, 53:35-70). The four serotypes show immunological cross-reactivity, but are distinguishable in plaque reduction neutralization tests and by their respective monoclonal antibodies. The dengue virus E protein includes a serotype-specific antigenic determinant and determinants necessary for virus neutralization (Mason et al., *J Gen Virol.* 1990, 71:2107-2114).

After inoculation, the dendritic cells become infected and travel to lymph nodes. Monocytes and macrophages are also targeted shortly thereafter. Generally, the infected individual will be protected against homotypic reinfection for life; however, the individual will only be protected against other serotypes for a few weeks or months (Sabin, *Am J Trop Med*

*Hyg.* 1952, 1:30-50). In fact, DHF/DSS is generally found in children and adults infected with a dengue virus serotype differing from their respective primary infection. Thus, it is necessary to develop a vaccine that provides immunity to all four serotypes.

The DENV E (envelope) protein is found on the viral surface and plays a role in the initial attachment of the viral particle to the host cell. Several molecules which interact with the viral E protein (ICAM3-grabbing non-integrin, CD209, Rab 5, GRP 78, and the mannose receptor) are thought to be important factors mediating attachment and viral entry.

The DENV prM (membrane) protein is important in the formation and maturation of the viral particle. The membrane protein consists of seven antiparallel β-strands stabilized by three disulfide bonds. The glycoprotein shell of the mature DENV virion consists of 180 copies each of the E protein and M protein. The immature virion comprises E and prM proteins, which form 90 heterodimer spikes on the exterior of the viral particle. The immature viral particle buds into the endoplasmic reticulum and eventually travels via the secretory pathway to the Golgi apparatus. As the virion passes through the trans-Golgi Network (TGN), it is exposed to an acidic environment which causes a conformational change in the E protein which causes it to disassociate from the prM protein and form E homodimers. During the maturation phase, the pr peptide is cleaved from the M peptide by the host protease, furin. The M protein then acts as a transmembrane protein under the E-protein shell of the mature virion. The pr peptide remains associated with the E protein until the viral particle is released into the extracellular environment, acting like a cap covering the hydrophobic fusion loop of the E protein until the viral particle has exited the cell.

The DENV NS3 is a serine protease, as well as an RNA helicase and RTPase/NTPase. The protease domain consists of six β-strands arranged into two β-barrels formed by residues 1-180 of the protein. The catalytic triad (His-51, Asp-75 and Ser-135), is found between these two β-barrels, and its activity is dependent on the presence of the NS2B cofactor which wraps around the NS3 protease domain and becomes part of the active site. The remaining NS3 residues (180-618), form the three subdomains of the DENV helicase. A six-stranded parallel β-sheet surrounded by four α-helices make up subdomains I and II, and subdomain III is composed of 4α-helices surrounded by three shorter α-helices and two antiparallel β-strands.

Chikungunya Virus (CHIKV)

Presently, CHIKV is a re-emerging human pathogen that has now established itself in Southeast Asia and has more recently spread to Europe. The Chikungunya virus (CHIKV) was introduced into Asia around 1958, and sites of endemic transmission within Southeastern Asia, including the Indian Ocean, were observed through 1996. The CHIKV epidemic moved throughout Asia, reaching Europe and Africa in the early 2000s, and was imported via travelers to North America and South America from 2005 to 2007. Sporadic outbreaks are still occurring in several countries, such as Italy, infecting naive populations. Singapore, for instance, experienced two successive waves of Chikungunya virus outbreaks in January and August 2008. Of the two strain lineages of CHIKV, the African strain remains enzootic by cycling between mosquitoes and monkeys, but the Asian strain is transmitted directly between mosquitoes and humans. This cycle of transmission may have allowed the virus to become more pathogenic as the reservoir host was eliminated.

In humans, CHIKV causes a debilitating disease characterized by fever, headache, nausea, vomiting, fatigue, rash, muscle pain and joint pain. Following the acute phase of the illness, patients develop severe chronic symptoms lasting from several weeks to months, including fatigue, incapacitating joint pain and polyarthritis.

The re-emergence of CHIKV has caused millions of cases throughout countries around the Indian Ocean and in Southeast Asia. Specifically, India, Indonesia, Maldives, Myanmar and Thailand have reported over 1.9 million cases since 2005. Globally, human CHIKV epidemics from 2004-2011 have resulted in 1.4-6.5 million reported cases, including a number of deaths. Thus, CHIKV remains a public threat that constitutes a major public health problem with severe social and economic impact.

Despite significant morbidity and some cases of mortality associated with CHIKV infection and its growing prevalence and geographic distribution, there is currently no licensed CHIKV vaccine or antiviral approved for human use. Several potential CHIKV vaccine candidates have been tested in humans and animals with varying success.

Chikungunya virus is a small (about 60-70 nm diameter), spherical, enveloped, positive-strand RNA virus having a capsid with icosahedral symmetry. The virion consists of an envelope and a nucleocapsid. The virion RNA is infectious and serves as both genome and viral messenger RNA. The genome is a linear, ssRNA(+) genome of 11,805 nucleotides which encodes two polyproteins that are processed by host and viral proteases into non-structural proteins (nsP1, nsP2, nsP3, and RdRpnsP4) necessary for RNA synthesis (replication and transcription) and structural proteins (capsid and envelope proteins C, E3, E2, 6K, and E1) which attach to host receptors and mediate endocytosis of virus into the host cell. The E1 and E2 glycoproteins form heterodimers that associate as 80 trimeric spikes on the viral surface covering the surface evenly. The envelope glycoproteins play a role in attachment to cells. The capsid protein possesses a protease activity that results in its self-cleavage from the nascent structural protein. Following its cleavage, the capsid protein binds to viral RNA and rapidly assembles into icosahedric core particles. The resulting nucleocapsid eventually associates with the cytoplasmic domain of E2 at the cell membrane, leading to budding and formation of mature virions.

E2 is an envelope glycoprotein responsible for viral attachment to target host cell, by binding to the cell receptor. E2 is synthesized as a p62 precursor which is processed at the cell membrane prior to virion budding, giving rise to an E2-E1 heterodimer. The C-terminus of E2 is involved in budding by interacting with capsid proteins.

E1 is an envelope glycoprotein with fusion activity, which is inactive as long as E1 is bound to E2 in the mature virion. Following virus attachment to target cell and endocytosis, acidification of the endosome induces dissociation of the E1/E2 heterodimer and concomitant trimerization of the E1 subunits. The E1 trimer is fusion active and promotes the release of the viral nucleocapsid in the cytoplasm after endosome and viral membrane fusion.

E3 is an accessory protein that functions as a membrane translocation/transport signal for E1 and E2.

6K is another accessory protein involved in virus glycoprotein processing, cell permeabilization, and the budding of viral particles. Like E3, it functions as a membrane transport signal for E1 and E2.

The CHIKV structural proteins have been shown to be antigenic, which proteins, fragments, and epitopes thereof are encompassed within the invention. A phylogenetic tree of Chikungunya virus strains derived from complete concatenated open reading frames for the nonstructural and structural polyproteins shows key envelope glycoprotein E1 amino acid substitutions that facilitated (Indian Ocean lineage) or prevented (Asian lineage) adaptation to *Aedes albopictus*. There are membrane-bound and secreted forms of E1 and E2, as well as the full length polyprotein antigen (C-E3-E2-6K-E1), which retains the protein's native conformation. Additionally, the different Chikungunya genotypes, strains and isolates can also yield different antigens, which are functional in the constructs of the invention. For example, there are several different Chikungunya genotypes: Indian Ocean, East/Central/South African (ECSA), Asian, West African, and the Brazilian isolates (ECSA/Asian). There are three main Chikungunya genotype. These are ESCA (East-South-Central Africa), Asia, and West Africa. While sometimes names differ in publications, all belong to these three geographical strains.

The entire contents of International Application No. PCT/US2015/02740 is incorporated herein by reference.

Combination Vaccines

Embodiments of the present disclosure also provide combination RNA (e.g., mRNA) vaccines. A "combination RNA (e.g., mRNA) vaccine" of the present disclosure refers to a vaccine comprising at least one (e.g., at least 2, 3, 4, 5, 6, 7, 8, 9 or 10) RNA (e.g., mRNA) polynucleotide having an open reading frame encoding a combination of at least one Malaria (e.g., *P. falciparum, P. vivax, P. malariae* and/or *P. ovale*) antigenic polypeptide, at least one JEV antigenic polypeptide, at least one WNV antigenic polypeptide, at least one EEEV antigenic polypeptide, at least one VEEV antigenic polypeptide, at least one SINV antigenic polypeptide, at least on CHIKV antigenic polypeptide, at least one DENV antigenic polypeptide, at least one ZIKV antigenic polypeptide, at least one YFV antigenic polypeptide, or any combination of two, three, four, five, six, seven, eight, nine, ten or more of the foregoing antigenic polypeptides.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a JEV antigenic polypeptide, a WNV antigenic polypeptide, a EEEV antigenic polypeptide, a VEEV antigenic polypeptide, a SINV antigenic polypeptide, a CHIKV antigenic polypeptide, a DENV antigenic polypeptide, a ZIKV antigenic polypeptide and a YFV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide and a JEV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide and a WNV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide and a EEEV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide and a VEEV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide and a SINV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide and a CHIKV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide and a DENV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide and a ZIKV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide and a YFV antigenic polypeptide.

In some embodiments, a combination RNA (e.g., mRNA) vaccine comprises a RNA (e.g., mRNA) polynucleotide encoding a JEV antigenic polypeptide and a WNV antigenic polypeptide.

In some embodiments, a combination RNA (e.g., mRNA) vaccine comprises a RNA (e.g., mRNA) polynucleotide encoding a JEV antigenic polypeptide and a EEEV antigenic polypeptide.

In some embodiments, a combination RNA (e.g., mRNA) vaccine comprises a RNA (e.g., mRNA) polynucleotide encoding a JEV antigenic polypeptide and a VEEV antigenic polypeptide.

In some embodiments, a combination RNA (e.g., mRNA) vaccine comprises a RNA (e.g., mRNA) polynucleotide encoding a JEV antigenic polypeptide and a SINV antigenic polypeptide.

In some embodiments, a combination RNA (e.g., mRNA) vaccine comprises a RNA (e.g., mRNA) polynucleotide encoding a JEV antigenic polypeptide and a CHIKV antigenic polypeptide.

In some embodiments, a combination RNA (e.g., mRNA) vaccine comprises a RNA (e.g., mRNA) polynucleotide encoding a JEV antigenic polypeptide and a DENV antigenic polypeptide.

In some embodiments, a combination RNA (e.g., mRNA) vaccine comprises a RNA (e.g., mRNA) polynucleotide encoding a JEV antigenic polypeptide and a ZIKV antigenic polypeptide.

In some embodiments, a combination RNA (e.g., mRNA) vaccine comprises a RNA (e.g., mRNA) polynucleotide encoding a JEV antigenic polypeptide and a YFV antigenic polypeptide.

In some embodiments, a combination RNA (e.g., mRNA) vaccine comprises a RNA (e.g., mRNA) polynucleotide encoding a WNV antigenic polypeptide and a EEEV antigenic polypeptide.

In some embodiments, a combination RNA (e.g., mRNA) vaccine comprises a RNA (e.g., mRNA) polynucleotide encoding a WNV antigenic polypeptide and a VEEV antigenic polypeptide.

In some embodiments, a combination RNA (e.g., mRNA) vaccine comprises a RNA (e.g., mRNA) polynucleotide encoding a WNV antigenic polypeptide and a SINV antigenic polypeptide.

In some embodiments, a combination RNA (e.g., mRNA) vaccine comprises a RNA (e.g., mRNA) polynucleotide encoding a WNV antigenic polypeptide and a CHIKV antigenic polypeptide.

In some embodiments, a combination RNA (e.g., mRNA) vaccine comprises a RNA (e.g., mRNA) polynucleotide encoding a WNV antigenic polypeptide and a DENV antigenic polypeptide.

In some embodiments, a combination RNA (e.g., mRNA) vaccine comprises a RNA (e.g., mRNA) polynucleotide encoding a WNV antigenic polypeptide and a ZIKV antigenic polypeptide.

In some embodiments, a combination RNA (e.g., mRNA) vaccine comprises a RNA (e.g., mRNA) polynucleotide encoding a WNV antigenic polypeptide and a YFV antigenic polypeptide.

In some embodiments, a combination RNA (e.g., mRNA) vaccine comprises a RNA (e.g., mRNA) polynucleotide encoding a EEEV antigenic polypeptide and a VEEV antigenic polypeptide.

In some embodiments, a combination RNA (e.g., mRNA) vaccine comprises a RNA (e.g., mRNA) polynucleotide encoding a EEEV antigenic polypeptide and a SINV antigenic polypeptide.

In some embodiments, a combination RNA (e.g., mRNA) vaccine comprises a RNA (e.g., mRNA) polynucleotide encoding a EEEV antigenic polypeptide and a CHIKV antigenic polypeptide.

In some embodiments, a combination RNA (e.g., mRNA) vaccine comprises a RNA (e.g., mRNA) polynucleotide encoding a EEEV antigenic polypeptide and a DENV antigenic polypeptide.

In some embodiments, a combination RNA (e.g., mRNA) vaccine comprises a RNA (e.g., mRNA) polynucleotide encoding a EEEV antigenic polypeptide and a ZIKV antigenic polypeptide.

In some embodiments, a combination RNA (e.g., mRNA) vaccine comprises a RNA (e.g., mRNA) polynucleotide encoding a EEEV antigenic polypeptide and a YFV antigenic polypeptide.

In some embodiments, a combination RNA (e.g., mRNA) vaccine comprises a RNA (e.g., mRNA) polynucleotide encoding a VEEV antigenic polypeptide and a SINV antigenic polypeptide.

In some embodiments, a combination RNA (e.g., mRNA) vaccine comprises a RNA (e.g., mRNA) polynucleotide encoding a VEEV antigenic polypeptide and a CHIKV antigenic polypeptide.

In some embodiments, a combination RNA (e.g., mRNA) vaccine comprises a RNA (e.g., mRNA) polynucleotide encoding a VEEV antigenic polypeptide and a DENV antigenic polypeptide.

In some embodiments, a combination RNA (e.g., mRNA) vaccine comprises a RNA (e.g., mRNA) polynucleotide encoding a VEEV antigenic polypeptide and a ZIKV antigenic polypeptide.

In some embodiments, a combination RNA (e.g., mRNA) vaccine comprises a RNA (e.g., mRNA) polynucleotide encoding a VEEV antigenic polypeptide and a YFV antigenic polypeptide.

In some embodiments, a combination RNA (e.g., mRNA) vaccine comprises a RNA (e.g., mRNA) polynucleotide encoding a SINV antigenic polypeptide and a CHIKV antigenic polypeptide.

In some embodiments, a combination RNA (e.g., mRNA) vaccine comprises a RNA (e.g., mRNA) polynucleotide encoding a SINV antigenic polypeptide and a DENV antigenic polypeptide.

In some embodiments, a combination RNA (e.g., mRNA) vaccine comprises a RNA (e.g., mRNA) polynucleotide encoding a SINV antigenic polypeptide and a ZIKV antigenic polypeptide.

In some embodiments, a combination RNA (e.g., mRNA) vaccine comprises a RNA (e.g., mRNA) polynucleotide encoding a SINV antigenic polypeptide and a YFV antigenic polypeptide.

In some embodiments, a combination RNA (e.g., mRNA) vaccine comprises a RNA (e.g., mRNA) polynucleotide encoding a CHIKV antigenic polypeptide and a DENV antigenic polypeptide.

In some embodiments, a combination RNA (e.g., mRNA) vaccine comprises a RNA (e.g., mRNA) polynucleotide encoding a CHIKV antigenic polypeptide and a ZIKV antigenic polypeptide.

In some embodiments, a combination RNA (e.g., mRNA) vaccine comprises a RNA (e.g., mRNA) polynucleotide encoding a CHIKV antigenic polypeptide and a YFV antigenic polypeptide.

In some embodiments, a combination RNA (e.g., mRNA) vaccine comprises a RNA (e.g., mRNA) polynucleotide encoding a DENV antigenic polypeptide and a ZIKV antigenic polypeptide.

In some embodiments, a combination RNA (e.g., mRNA) vaccine comprises a RNA (e.g., mRNA) polynucleotide encoding a DENV antigenic polypeptide and a YFV antigenic polypeptide.

In some embodiments, a combination RNA (e.g., mRNA) vaccine comprises a RNA (e.g., mRNA) polynucleotide encoding a ZIKV antigenic polypeptide and a YFV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a JEV antigenic polypeptide and a WNV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a JEV antigenic polypeptide and a EEEV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a JEV antigenic polypeptide and a VEEV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a JEV antigenic polypeptide and a SINV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a JEV antigenic polypeptide and a CHIKV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a JEV antigenic polypeptide and a DENV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a JEV antigenic polypeptide and a ZIKV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a JEV antigenic polypeptide and a YFV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a WNV antigenic polypeptide and a EEEV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a WNV antigenic polypeptide and a VEEV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a WNV antigenic polypeptide and a SINV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a WNV antigenic polypeptide and a CHIKV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a WNV antigenic polypeptide and a DENV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a WNV antigenic polypeptide and a ZIKV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a WNV antigenic polypeptide and a YFV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a EEEV antigenic polypeptide and a VEEV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a EEEV antigenic polypeptide and a SINV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a EEEV antigenic polypeptide and a CHIKV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a EEEV antigenic polypeptide and a DENV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a EEEV antigenic polypeptide and a ZIKV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a EEEV antigenic polypeptide and a YFV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a VEEV antigenic polypeptide and a SINV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a VEEV antigenic polypeptide and a CHIKV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a VEEV antigenic polypeptide and a DENV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a VEEV antigenic polypeptide and a ZIKV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a VEEV antigenic polypeptide and a YFV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, SINV antigenic polypeptide and a CHIKV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, SINV antigenic polypeptide and a DENV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, SINV antigenic polypeptide and a ZIKV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, SINV antigenic polypeptide and a YFV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a CHIKV antigenic polypeptide and a DENV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a CHIKV antigenic polypeptide and a ZIKV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a CHIKV antigenic polypeptide and a YFV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a DENV antigenic polypeptide and a ZIKV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a DENV antigenic polypeptide and a YFV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a ZIKV antigenic polypeptide and a YFV antigenic polypeptide.

In some embodiments, a combination RNA (e.g., mRNA) vaccine comprises a RNA (e.g., mRNA) polynucleotide encoding a JEV antigenic polypeptide, a WNV antigenic polypeptide and a EEEV antigenic polypeptide.

In some embodiments, a combination RNA (e.g., mRNA) vaccine comprises a RNA (e.g., mRNA) polynucleotide encoding a JEV antigenic polypeptide, a WNV antigenic polypeptide and a VEEV antigenic polypeptide.

In some embodiments, a combination RNA (e.g., mRNA) vaccine comprises a RNA (e.g., mRNA) polynucleotide encoding a JEV antigenic polypeptide, a WNV antigenic polypeptide and a SINV antigenic polypeptide.

In some embodiments, a combination RNA (e.g., mRNA) vaccine comprises a RNA (e.g., mRNA) polynucleotide encoding a JEV antigenic polypeptide, a WNV antigenic polypeptide and a CHIKV antigenic polypeptide.

In some embodiments, a combination RNA (e.g., mRNA) vaccine comprises a RNA (e.g., mRNA) polynucleotide encoding a JEV antigenic polypeptide, a WNV antigenic polypeptide and a DENV antigenic polypeptide.

In some embodiments, a combination RNA (e.g., mRNA) vaccine comprises a RNA (e.g., mRNA) polynucleotide encoding a JEV antigenic polypeptide, a WNV antigenic polypeptide and a ZIKV antigenic polypeptide.

In some embodiments, a combination RNA (e.g., mRNA) vaccine comprises a RNA (e.g., mRNA) polynucleotide encoding a JEV antigenic polypeptide, a WNV antigenic polypeptide and a YFV antigenic polypeptide.

In some embodiments, a combination RNA (e.g., mRNA) vaccine comprises a RNA (e.g., mRNA) polynucleotide encoding a JEV antigenic polypeptide, a EEEV antigenic polypeptide and a VEEV antigenic polypeptide.

In some embodiments, a combination RNA (e.g., mRNA) vaccine comprises a RNA (e.g., mRNA) polynucleotide encoding a JEV antigenic polypeptide, a EEEV antigenic polypeptide and a SINV antigenic polypeptide.

In some embodiments, a combination RNA (e.g., mRNA) vaccine comprises a RNA (e.g., mRNA) polynucleotide encoding a JEV antigenic polypeptide, a EEEV antigenic polypeptide and a CHIKV antigenic polypeptide.

In some embodiments, a combination RNA (e.g., mRNA) vaccine comprises a RNA (e.g., mRNA) polynucleotide encoding a JEV antigenic polypeptide, a EEEV antigenic polypeptide and a DENV antigenic polypeptide.

In some embodiments, a combination RNA (e.g., mRNA) vaccine comprises a RNA (e.g., mRNA) polynucleotide encoding a JEV antigenic polypeptide, a EEEV antigenic polypeptide and a ZIKV antigenic polypeptide.

In some embodiments, a combination RNA (e.g., mRNA) vaccine comprises a RNA (e.g., mRNA) polynucleotide encoding a JEV antigenic polypeptide, a EEEV antigenic polypeptide and a YFV antigenic polypeptide.

In some embodiments, a combination RNA (e.g., mRNA) vaccine comprises a RNA (e.g., mRNA) polynucleotide encoding a JEV antigenic polypeptide, a VEEV antigenic polypeptide and a SINV antigenic polypeptide.

In some embodiments, a combination RNA (e.g., mRNA) vaccine comprises a RNA (e.g., mRNA) polynucleotide encoding a JEV antigenic polypeptide, a VEEV antigenic polypeptide and a CHIKV antigenic polypeptide.

In some embodiments, a combination RNA (e.g., mRNA) vaccine comprises a RNA (e.g., mRNA) polynucleotide encoding a JEV antigenic polypeptide, a VEEV antigenic polypeptide and a DENV antigenic polypeptide.

In some embodiments, a combination RNA (e.g., mRNA) vaccine comprises a RNA (e.g., mRNA) polynucleotide encoding a JEV antigenic polypeptide, a VEEV antigenic polypeptide and a ZIKV antigenic polypeptide.

In some embodiments, a combination RNA (e.g., mRNA) vaccine comprises a RNA (e.g., mRNA) polynucleotide encoding a JEV antigenic polypeptide, a VEEV antigenic polypeptide and a YFV antigenic polypeptide.

In some embodiments, a combination RNA (e.g., mRNA) vaccine comprises a RNA (e.g., mRNA) polynucleotide encoding a JEV antigenic polypeptide, a SINV antigenic polypeptide and a CHIKV antigenic polypeptide.

In some embodiments, a combination RNA (e.g., mRNA) vaccine comprises a RNA (e.g., mRNA) polynucleotide encoding a JEV antigenic polypeptide, a SINV antigenic polypeptide and DENV antigenic polypeptide.

In some embodiments, a combination RNA (e.g., mRNA) vaccine comprises a RNA (e.g., mRNA) polynucleotide encoding a JEV antigenic polypeptide, a SINV antigenic polypeptide and a ZIKV antigenic polypeptide.

In some embodiments, a combination RNA (e.g., mRNA) vaccine comprises a RNA (e.g., mRNA) polynucleotide encoding a JEV antigenic polypeptide, a SINV antigenic polypeptide and a YFV antigenic polypeptide.

In some embodiments, a combination RNA (e.g., mRNA) vaccine comprises a RNA (e.g., mRNA) polynucleotide encoding a JEV antigenic polypeptide, CHIKV antigenic polypeptide and a DENV antigenic polypeptide.

In some embodiments, a combination RNA (e.g., mRNA) vaccine comprises a RNA (e.g., mRNA) polynucleotide encoding a JEV antigenic polypeptide, CHIKV antigenic polypeptide and a ZIKV antigenic polypeptide.

In some embodiments, a combination RNA (e.g., mRNA) vaccine comprises a RNA (e.g., mRNA) polynucleotide encoding a JEV antigenic polypeptide, CHIKV antigenic polypeptide and a YFV antigenic polypeptide.

In some embodiments, a combination RNA (e.g., mRNA) vaccine comprises a RNA (e.g., mRNA) polynucleotide encoding a JEV antigenic polypeptide, a DENV antigenic polypeptide and a ZIKV antigenic polypeptide.

In some embodiments, a combination RNA (e.g., mRNA) vaccine comprises a RNA (e.g., mRNA) polynucleotide encoding a JEV antigenic polypeptide, a DENV antigenic polypeptide and a YFV antigenic polypeptide.

In some embodiments, a combination RNA (e.g., mRNA) vaccine comprises a RNA (e.g., mRNA) polynucleotide encoding a JEV antigenic polypeptide, a ZIKV antigenic polypeptide and a YFV antigenic polypeptide.

In some embodiments, a combination RNA (e.g., mRNA) vaccine comprises a RNA (e.g., mRNA) polynucleotide encoding a WNV antigenic polypeptide, a EEEV antigenic polypeptide and a VEEV antigenic polypeptide.

In some embodiments, a combination RNA (e.g., mRNA) vaccine comprises a RNA (e.g., mRNA) polynucleotide encoding a WNV antigenic polypeptide, a EEEV antigenic polypeptide and a SINV antigenic polypeptide.

In some embodiments, a combination RNA (e.g., mRNA) vaccine comprises a RNA (e.g., mRNA) polynucleotide encoding a WNV antigenic polypeptide, a EEEV antigenic polypeptide and a CHIKV antigenic polypeptide.

In some embodiments, a combination RNA (e.g., mRNA) vaccine comprises a RNA (e.g., mRNA) polynucleotide encoding a WNV antigenic polypeptide, a EEEV antigenic polypeptide and a DENV antigenic polypeptide.

In some embodiments, a combination RNA (e.g., mRNA) vaccine comprises a RNA (e.g., mRNA) polynucleotide encoding a WNV antigenic polypeptide, a EEEV antigenic polypeptide and a ZIKV antigenic polypeptide.

In some embodiments, a combination RNA (e.g., mRNA) vaccine comprises a RNA (e.g., mRNA) polynucleotide encoding a WNV antigenic polypeptide, a EEEV antigenic polypeptide and a YFV antigenic polypeptide.

In some embodiments, a combination RNA (e.g., mRNA) vaccine comprises a RNA (e.g., mRNA) polynucleotide encoding WNV antigenic polypeptide, a VEEV antigenic polypeptide and a SINV antigenic polypeptide.

In some embodiments, a combination RNA (e.g., mRNA) vaccine comprises a RNA (e.g., mRNA) polynucleotide encoding WNV antigenic polypeptide, a VEEV antigenic polypeptide and a CHIKV antigenic polypeptide.

In some embodiments, a combination RNA (e.g., mRNA) vaccine comprises a RNA (e.g., mRNA) polynucleotide encoding WNV antigenic polypeptide, a VEEV antigenic polypeptide and a DENV antigenic polypeptide.

In some embodiments, a combination RNA (e.g., mRNA) vaccine comprises a RNA (e.g., mRNA) polynucleotide encoding WNV antigenic polypeptide, a VEEV antigenic polypeptide and a ZIKV antigenic polypeptide.

In some embodiments, a combination RNA (e.g., mRNA) vaccine comprises a RNA (e.g., mRNA) polynucleotide encoding WNV antigenic polypeptide, a VEEV antigenic polypeptide and a YFV antigenic polypeptide.

In some embodiments, a combination RNA (e.g., mRNA) vaccine comprises a RNA (e.g., mRNA) polynucleotide encoding a WNV antigenic polypeptide, a SINV antigenic polypeptide and a CHIKV antigenic polypeptide.

In some embodiments, a combination RNA (e.g., mRNA) vaccine comprises a RNA (e.g., mRNA) polynucleotide encoding a WNV antigenic polypeptide, a SINV antigenic polypeptide and a DENV antigenic polypeptide.

In some embodiments, a combination RNA (e.g., mRNA) vaccine comprises a RNA (e.g., mRNA) polynucleotide encoding a WNV antigenic polypeptide, a SINV antigenic polypeptide and a ZIKV antigenic polypeptide.

In some embodiments, a combination RNA (e.g., mRNA) vaccine comprises a RNA (e.g., mRNA) polynucleotide encoding a WNV antigenic polypeptide, a SINV antigenic polypeptide and a YFV antigenic polypeptide.

In some embodiments, a combination RNA (e.g., mRNA) vaccine comprises a RNA (e.g., mRNA) polynucleotide encoding a WNV antigenic polypeptide, a SINV antigenic polypeptide and a CHIKV antigenic polypeptide.

In some embodiments, a combination RNA (e.g., mRNA) vaccine comprises a RNA (e.g., mRNA) polynucleotide encoding a WNV antigenic polypeptide, a SINV antigenic polypeptide and a DENV antigenic polypeptide.

In some embodiments, a combination RNA (e.g., mRNA) vaccine comprises a RNA (e.g., mRNA) polynucleotide encoding a WNV antigenic polypeptide, a SINV antigenic polypeptide and a ZIKV antigenic polypeptide.

In some embodiments, a combination RNA (e.g., mRNA) vaccine comprises a RNA (e.g., mRNA) polynucleotide encoding a WNV antigenic polypeptide, a SINV antigenic polypeptide and a YFV antigenic polypeptide.

In some embodiments, a combination RNA (e.g., mRNA) vaccine comprises a RNA (e.g., mRNA) polynucleotide encoding a WNV antigenic polypeptide, a CHIKV antigenic polypeptide and a DENV antigenic polypeptide.

In some embodiments, a combination RNA (e.g., mRNA) vaccine comprises a RNA (e.g., mRNA) polynucleotide encoding a WNV antigenic polypeptide, a CHIKV antigenic polypeptide and a ZIKV antigenic polypeptide.

In some embodiments, a combination RNA (e.g., mRNA) vaccine comprises a RNA (e.g., mRNA) polynucleotide encoding a WNV antigenic polypeptide, a CHIKV antigenic polypeptide and a YFV antigenic polypeptide.

In some embodiments, a combination RNA (e.g., mRNA) vaccine comprises a RNA (e.g., mRNA) polynucleotide encoding a WNV antigenic polypeptide, a DENV antigenic polypeptide and a ZIKV antigenic polypeptide.

In some embodiments, a combination RNA (e.g., mRNA) vaccine comprises a RNA (e.g., mRNA) polynucleotide encoding a WNV antigenic polypeptide, a DENV antigenic polypeptide and YFV antigenic polypeptide.

In some embodiments, a combination RNA (e.g., mRNA) vaccine comprises a RNA (e.g., mRNA) polynucleotide encoding a WNV antigenic polypeptide, a ZIKV antigenic polypeptide and YFV antigenic polypeptide.

In some embodiments, a combination RNA (e.g., mRNA) vaccine comprises a RNA (e.g., mRNA) polynucleotide encoding a EEEV antigenic polypeptide, a VEEV antigenic polypeptide and a SINV antigenic polypeptide.

In some embodiments, a combination RNA (e.g., mRNA) vaccine comprises a RNA (e.g., mRNA) polynucleotide encoding a EEEV antigenic polypeptide, a VEEV antigenic polypeptide and a CHIKV antigenic polypeptide.

In some embodiments, a combination RNA (e.g., mRNA) vaccine comprises a RNA (e.g., mRNA) polynucleotide encoding a EEEV antigenic polypeptide, a VEEV antigenic polypeptide and a DENV antigenic polypeptide.

In some embodiments, a combination RNA (e.g., mRNA) vaccine comprises a RNA (e.g., mRNA) polynucleotide encoding a EEEV antigenic polypeptide, a VEEV antigenic polypeptide and a ZIKV antigenic polypeptide.

In some embodiments, a combination RNA (e.g., mRNA) vaccine comprises a RNA (e.g., mRNA) polynucleotide encoding a EEEV antigenic polypeptide, a VEEV antigenic polypeptide and a YFV antigenic polypeptide.

In some embodiments, a combination RNA (e.g., mRNA) vaccine comprises a RNA (e.g., mRNA) polynucleotide encoding a EEEV antigenic polypeptide, a SINV antigenic polypeptide and a CHIKV antigenic polypeptide.

In some embodiments, a combination RNA (e.g., mRNA) vaccine comprises a RNA (e.g., mRNA) polynucleotide encoding a EEEV antigenic polypeptide, a SINV antigenic polypeptide and a DENV antigenic polypeptide.

In some embodiments, a combination RNA (e.g., mRNA) vaccine comprises a RNA (e.g., mRNA) polynucleotide encoding a EEEV antigenic polypeptide, a SINV antigenic polypeptide and a ZIKV antigenic polypeptide.

In some embodiments, a combination RNA (e.g., mRNA) vaccine comprises a RNA (e.g., mRNA) polynucleotide encoding a EEEV antigenic polypeptide, a SINV antigenic polypeptide and a YFV antigenic polypeptide.

In some embodiments, a combination RNA (e.g., mRNA) vaccine comprises a RNA (e.g., mRNA) polynucleotide encoding a EEEV antigenic polypeptide, a CHIKV antigenic polypeptide and a DENV antigenic polypeptide.

In some embodiments, a combination RNA (e.g., mRNA) vaccine comprises a RNA (e.g., mRNA) polynucleotide encoding a EEEV antigenic polypeptide, a CHIKV antigenic polypeptide and a ZIKV antigenic polypeptide.

In some embodiments, a combination RNA (e.g., mRNA) vaccine comprises a RNA (e.g., mRNA) polynucleotide encoding a EEEV antigenic polypeptide, a CHIKV antigenic polypeptide and a YFV antigenic polypeptide.

In some embodiments, a combination RNA (e.g., mRNA) vaccine comprises a RNA (e.g., mRNA) polynucleotide encoding a EEEV antigenic polypeptide, a DENV antigenic polypeptide and a ZIKV antigenic polypeptide.

In some embodiments, a combination RNA (e.g., mRNA) vaccine comprises a RNA (e.g., mRNA) polynucleotide encoding a EEEV antigenic polypeptide, a DENV antigenic polypeptide and a YFV antigenic polypeptide.

In some embodiments, a combination RNA (e.g., mRNA) vaccine comprises a RNA (e.g., mRNA) polynucleotide encoding a EEEV antigenic polypeptide, a ZIKV antigenic polypeptide and a YFV antigenic polypeptide.

In some embodiments, a combination RNA (e.g., mRNA) vaccine comprises a RNA (e.g., mRNA) polynucleotide encoding a VEEV antigenic polypeptide, a SINV antigenic polypeptide and a CHIKV antigenic polypeptide.

In some embodiments, a combination RNA (e.g., mRNA) vaccine comprises a RNA (e.g., mRNA) polynucleotide encoding a VEEV antigenic polypeptide, a SINV antigenic polypeptide and a DENV antigenic polypeptide.

In some embodiments, a combination RNA (e.g., mRNA) vaccine comprises a RNA (e.g., mRNA) polynucleotide encoding a VEEV antigenic polypeptide, a SINV antigenic polypeptide and a ZIKV antigenic polypeptide.

In some embodiments, a combination RNA (e.g., mRNA) vaccine comprises a RNA (e.g., mRNA) polynucleotide encoding a VEEV antigenic polypeptide, a SINV antigenic polypeptide and a YFV antigenic polypeptide.

In some embodiments, a combination RNA (e.g., mRNA) vaccine comprises a RNA (e.g., mRNA) polynucleotide encoding a VEEV antigenic polypeptide, a CHIKV antigenic polypeptide and a DENV antigenic polypeptide.

In some embodiments, a combination RNA (e.g., mRNA) vaccine comprises a RNA (e.g., mRNA) polynucleotide encoding a VEEV antigenic polypeptide, a CHIKV antigenic polypeptide and a ZIKV antigenic polypeptide.

In some embodiments, a combination RNA (e.g., mRNA) vaccine comprises a RNA (e.g., mRNA) polynucleotide encoding a VEEV antigenic polypeptide, a CHIKV antigenic polypeptide and a YFV antigenic polypeptide.

In some embodiments, a combination RNA (e.g., mRNA) vaccine comprises a RNA (e.g., mRNA) polynucleotide encoding a VEEV antigenic polypeptide, a DENV antigenic polypeptide and a ZIKV antigenic polypeptide.

In some embodiments, a combination RNA (e.g., mRNA) vaccine comprises a RNA (e.g., mRNA) polynucleotide encoding a VEEV antigenic polypeptide, a DENV antigenic polypeptide and a YFV antigenic polypeptide.

In some embodiments, a combination RNA (e.g., mRNA) vaccine comprises a RNA (e.g., mRNA) polynucleotide encoding a VEEV antigenic polypeptide, a ZIKV antigenic polypeptide and a YFV antigenic polypeptide.

In some embodiments, a combination RNA (e.g., mRNA) vaccine comprises a RNA (e.g., mRNA) polynucleotide encoding a SINV antigenic polypeptide, a CHIKV antigenic polypeptide and a DENV antigenic polypeptide.

In some embodiments, a combination RNA (e.g., mRNA) vaccine comprises a RNA (e.g., mRNA) polynucleotide encoding a SINV antigenic polypeptide, a CHIKV antigenic polypeptide and a ZIKV antigenic polypeptide.

In some embodiments, a combination RNA (e.g., mRNA) vaccine comprises a RNA (e.g., mRNA) polynucleotide encoding a SINV antigenic polypeptide, a CHIKV antigenic polypeptide and a YFV antigenic polypeptide.

In some embodiments, a combination RNA (e.g., mRNA) vaccine comprises a RNA (e.g., mRNA) polynucleotide encoding a SINV antigenic polypeptide, a DENV antigenic polypeptide and a ZIKV antigenic polypeptide.

In some embodiments, a combination RNA (e.g., mRNA) vaccine comprises a RNA (e.g., mRNA) polynucleotide encoding a SINV antigenic polypeptide, a DENV antigenic polypeptide and a YFV antigenic polypeptide.

In some embodiments, a combination RNA (e.g., mRNA) vaccine comprises a RNA (e.g., mRNA) polynucleotide encoding a SINV antigenic polypeptide, a ZIKV antigenic polypeptide and a YFV antigenic polypeptide.

In some embodiments, a combination RNA (e.g., mRNA) vaccine comprises a RNA (e.g., mRNA) polynucleotide encoding a CHIKV antigenic polypeptide, a DENV antigenic polypeptide and a ZIKV antigenic polypeptide.

In some embodiments, a combination RNA (e.g., mRNA) vaccine comprises a RNA (e.g., mRNA) polynucleotide encoding a CHIKV antigenic polypeptide, a DENV antigenic polypeptide and a YFV antigenic polypeptide.

In some embodiments, a combination RNA (e.g., mRNA) vaccine comprises a RNA (e.g., mRNA) polynucleotide encoding a CHIKV antigenic polypeptide, a ZIKV antigenic polypeptide and a YFV antigenic polypeptide.

In some embodiments, a combination RNA (e.g., mRNA) vaccine comprises a RNA (e.g., mRNA) polynucleotide encoding a DENV antigenic polypeptide, a ZIKV antigenic polypeptide and a YFV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a JEV antigenic polypeptide, a WNV antigenic polypeptide and a EEEV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a JEV antigenic polypeptide, a WNV antigenic polypeptide and a VEEV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a JEV antigenic polypeptide, a WNV antigenic polypeptide and a SINV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a JEV antigenic polypeptide, a WNV antigenic polypeptide and a CHIKV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a JEV antigenic polypeptide, a WNV antigenic polypeptide and a DENV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a JEV antigenic polypeptide, a WNV antigenic polypeptide and a ZIKV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a JEV antigenic polypeptide, a WNV antigenic polypeptide and a YFV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a JEV antigenic polypeptide, a EEEV antigenic polypeptide and a VEEV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a JEV antigenic polypeptide, a EEEV antigenic polypeptide and a SINV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a JEV antigenic polypeptide, a EEEV antigenic polypeptide and a CHIKV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a JEV antigenic polypeptide, a EEEV antigenic polypeptide and a DENV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a JEV antigenic polypeptide, a EEEV antigenic polypeptide and a ZIKV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a JEV antigenic polypeptide, a EEEV antigenic polypeptide and a YFV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a JEV antigenic polypeptide and a VEEV antigenic polypeptide and a SINV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a JEV antigenic polypeptide and a VEEV antigenic polypeptide and a CHIKV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a JEV antigenic polypeptide and a VEEV antigenic polypeptide and a DENV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a JEV antigenic polypeptide and a VEEV antigenic polypeptide and a ZIKV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a JEV antigenic polypeptide and a VEEV antigenic polypeptide and a YFV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a JEV antigenic polypeptide, a SINV antigenic polypeptide and a CHIKV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a JEV antigenic polypeptide, a SINV antigenic polypeptide and a DENV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a JEV antigenic polypeptide, a SINV antigenic polypeptide and a ZIKV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a JEV antigenic polypeptide, a SINV antigenic polypeptide and a YFV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a JEV antigenic polypeptide, a CHIKV antigenic polypeptide and a DENV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a JEV antigenic polypeptide, a CHIKV antigenic polypeptide and a ZIKV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a JEV antigenic polypeptide, a CHIKV antigenic polypeptide and a YFV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a JEV antigenic polypeptide, a DENV antigenic polypeptide and a ZIKV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a JEV antigenic polypeptide, a DENV antigenic polypeptide and a YFV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a JEV antigenic polypeptide, a ZIKV antigenic polypeptide and a YFV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a WNV antigenic polypeptide, a EEEV antigenic polypeptide and a VEEV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a WNV antigenic polypeptide, a EEEV antigenic polypeptide and a SINV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a WNV antigenic polypeptide, a EEEV antigenic polypeptide and a CHIKV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a WNV antigenic polypeptide, a EEEV antigenic polypeptide and a DENV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a WNV antigenic polypeptide, a EEEV antigenic polypeptide and a ZIKV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a WNV antigenic polypeptide, a EEEV antigenic polypeptide and a YFV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a WNV antigenic polypeptide, a VEEV antigenic polypeptide and a SINV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a WNV antigenic polypeptide, a VEEV antigenic polypeptide and a CHIKV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a WNV antigenic polypeptide, a VEEV antigenic polypeptide and a DENV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a WNV antigenic polypeptide, a VEEV antigenic polypeptide and a ZIKV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a WNV antigenic polypeptide, a VEEV antigenic polypeptide and a YFV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a WNV antigenic polypeptide, a SINV antigenic polypeptide and a CHIKV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a WNV antigenic polypeptide, a SINV antigenic polypeptide and a DENV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a WNV antigenic polypeptide, a SINV antigenic polypeptide and a ZIKV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a WNV antigenic polypeptide, a SINV antigenic polypeptide and YFV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a WNV antigenic polypeptide, a CHIKV antigenic polypeptide and a DENV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a WNV antigenic polypeptide, a CHIKV antigenic polypeptide and a ZIKV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a WNV antigenic polypeptide, a CHIKV antigenic polypeptide and a YFV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a WNV antigenic polypeptide, DENV antigenic polypeptide and a ZIKV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a WNV antigenic polypeptide, DENV antigenic polypeptide and a YFV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a WNV antigenic polypeptide, ZIKV antigenic polypeptide and a YFV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, EEEV antigenic polypeptide, a VEEV antigenic polypeptide and a SINV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, EEEV antigenic polypeptide, a VEEV antigenic polypeptide and a CHIKV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, EEEV antigenic polypeptide, a VEEV antigenic polypeptide and a DENV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, EEEV antigenic polypeptide, a VEEV antigenic polypeptide and a ZIKV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, EEEV antigenic polypeptide, a VEEV antigenic polypeptide and a YFV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a SINV antigenic polypeptide and a CHIKV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a SINV antigenic polypeptide and a DENV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a SINV antigenic polypeptide and a ZIKV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a SINV antigenic polypeptide and a YFV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a EEEV antigenic polypeptide, a CHIKV antigenic polypeptide and a DENV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a EEEV antigenic polypeptide, a CHIKV antigenic polypeptide and a ZIKV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a EEEV antigenic polypeptide, a CHIKV antigenic polypeptide and a YFV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a EEEV antigenic polypeptide, DENV antigenic polypeptide and a ZIKV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a EEEV antigenic polypeptide, DENV antigenic polypeptide and a YFV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a EEEV antigenic polypeptide, a ZIKV antigenic polypeptide and a YFV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a VEEV antigenic polypeptide, a SINV antigenic polypeptide and a CHIKV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a VEEV antigenic polypeptide, a SINV antigenic polypeptide and a DENV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a VEEV antigenic polypeptide, a SINV antigenic polypeptide and a ZIKV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a VEEV antigenic polypeptide, a SINV antigenic polypeptide and a YFV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a VEEV antigenic polypeptide, a CHIKV antigenic polypeptide and a DENV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a VEEV antigenic polypeptide, a CHIKV antigenic polypeptide and a ZIKV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a VEEV antigenic polypeptide, a CHIKV antigenic polypeptide and a YFV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a VEEV antigenic polypeptide, a DENV antigenic polypeptide and a ZIKV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a VEEV antigenic polypeptide, a DENV antigenic polypeptide and a YFV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a VEEV antigenic polypeptide, a ZIKV antigenic polypeptide and a YFV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a SINV antigenic polypeptide, a CHIKV antigenic polypeptide and a DENV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a SINV antigenic polypeptide, a CHIKV antigenic polypeptide and a ZIKV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a SINV antigenic polypeptide, a CHIKV antigenic polypeptide and a YFV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a SINV antigenic polypeptide, a DENV antigenic polypeptide and a ZIKV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a SINV antigenic polypeptide, a DENV antigenic polypeptide and a YFV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a SINV antigenic polypeptide, a ZIKV antigenic polypeptide and a YFV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a CHIKV antigenic polypeptide, a DENV antigenic polypeptide and a ZIKV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a CHIKV antigenic polypeptide, a DENV antigenic polypeptide and a YFV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a CHIKV antigenic polypeptide, a ZIKV antigenic polypeptide and a YFV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a DENV antigenic polypeptide, a ZIKV antigenic polypeptide and a YFV antigenic polypeptide.

In some embodiments, a combination RNA (e.g., mRNA) vaccine comprises a RNA (e.g., mRNA) polynucleotide encoding a JEV antigenic polypeptide, a WNV antigenic polypeptide, a EEEV antigenic polypeptide and a VEEV antigenic.

In some embodiments, a combination RNA (e.g., mRNA) vaccine comprises a RNA (e.g., mRNA) polynucleotide encoding a JEV antigenic polypeptide, a WNV antigenic polypeptide, a EEEV antigenic polypeptide and a SINV antigenic polypeptide.

In some embodiments, a combination RNA (e.g., mRNA) vaccine comprises a RNA (e.g., mRNA) polynucleotide encoding a JEV antigenic polypeptide, a WNV antigenic polypeptide, a EEEV antigenic polypeptide and a CHIKV antigenic polypeptide.

In some embodiments, a combination RNA (e.g., mRNA) vaccine comprises a RNA (e.g., mRNA) polynucleotide encoding a JEV antigenic polypeptide, a WNV antigenic polypeptide, a EEEV antigenic polypeptide and a DENV antigenic polypeptide.

In some embodiments, a combination RNA (e.g., mRNA) vaccine comprises a RNA (e.g., mRNA) polynucleotide encoding a JEV antigenic polypeptide, a WNV antigenic polypeptide, a EEEV antigenic polypeptide and a ZIKV antigenic polypeptide.

In some embodiments, a combination RNA (e.g., mRNA) vaccine comprises a RNA (e.g., mRNA) polynucleotide encoding a JEV antigenic polypeptide, a WNV antigenic polypeptide, a EEEV antigenic polypeptide and a YFV antigenic polypeptide.

In some embodiments, a combination RNA (e.g., mRNA) vaccine comprises a RNA (e.g., mRNA) polynucleotide encoding a JEV antigenic polypeptide, a WNV antigenic polypeptide, a VEEV antigenic polypeptide and a SINV antigenic polypeptide.

In some embodiments, a combination RNA (e.g., mRNA) vaccine comprises a RNA (e.g., mRNA) polynucleotide encoding a JEV antigenic polypeptide, a WNV antigenic polypeptide, a VEEV antigenic polypeptide and a CHIKV antigenic polypeptide.

In some embodiments, a combination RNA (e.g., mRNA) vaccine comprises a RNA (e.g., mRNA) polynucleotide encoding a JEV antigenic polypeptide, a WNV antigenic polypeptide, a VEEV antigenic polypeptide and a DENV antigenic polypeptide.

In some embodiments, a combination RNA (e.g., mRNA) vaccine comprises a RNA (e.g., mRNA) polynucleotide encoding a JEV antigenic polypeptide, a WNV antigenic polypeptide, a VEEV antigenic polypeptide and a ZIKV antigenic polypeptide.

In some embodiments, a combination RNA (e.g., mRNA) vaccine comprises a RNA (e.g., mRNA) polynucleotide encoding a JEV antigenic polypeptide, a WNV antigenic polypeptide, a VEEV antigenic polypeptide and a YFV antigenic polypeptide.

In some embodiments, a combination RNA (e.g., mRNA) vaccine comprises a RNA (e.g., mRNA) polynucleotide encoding a JEV antigenic polypeptide, a WNV antigenic polypeptide, a VEEV antigenic polypeptide and a SINV antigenic polypeptide.

In some embodiments, a combination RNA (e.g., mRNA) vaccine comprises a RNA (e.g., mRNA) polynucleotide encoding a JEV antigenic polypeptide, a WNV antigenic polypeptide, a VEEV antigenic polypeptide and a CHIKV antigenic polypeptide.

In some embodiments, a combination RNA (e.g., mRNA) vaccine comprises a RNA (e.g., mRNA) polynucleotide encoding a JEV antigenic polypeptide, a WNV antigenic polypeptide, a VEEV antigenic polypeptide and a DENV antigenic polypeptide.

In some embodiments, a combination RNA (e.g., mRNA) vaccine comprises a RNA (e.g., mRNA) polynucleotide encoding a JEV antigenic polypeptide, a WNV antigenic polypeptide, a VEEV antigenic polypeptide and a ZIKV antigenic polypeptide and a YFV antigenic polypeptide.

In some embodiments, a combination RNA (e.g., mRNA) vaccine comprises a RNA (e.g., mRNA) polynucleotide encoding a JEV antigenic polypeptide, a WNV antigenic polypeptide, a VEEV antigenic polypeptide and a YFV antigenic polypeptide.

In some embodiments, a combination RNA (e.g., mRNA) vaccine comprises a RNA (e.g., mRNA) polynucleotide encoding a JEV antigenic polypeptide, a WNV antigenic polypeptide, a SINV antigenic polypeptide and a CHIKV antigenic polypeptide.

In some embodiments, a combination RNA (e.g., mRNA) vaccine comprises a RNA (e.g., mRNA) polynucleotide encoding a JEV antigenic polypeptide, a WNV antigenic polypeptide, a SINV antigenic polypeptide and a DENV antigenic polypeptide.

In some embodiments, a combination RNA (e.g., mRNA) vaccine comprises a RNA (e.g., mRNA) polynucleotide encoding a JEV antigenic polypeptide, a WNV antigenic polypeptide, a SINV antigenic polypeptide and a ZIKV antigenic polypeptide.

In some embodiments, a combination RNA (e.g., mRNA) vaccine comprises a RNA (e.g., mRNA) polynucleotide encoding a JEV antigenic polypeptide, a WNV antigenic polypeptide, a SINV antigenic polypeptide and a YFV antigenic polypeptide.

In some embodiments, a combination RNA (e.g., mRNA) vaccine comprises a RNA (e.g., mRNA) polynucleotide encoding a JEV antigenic polypeptide, a WNV antigenic polypeptide, a CHIKV antigenic polypeptide and a DENV antigenic polypeptide.

In some embodiments, a combination RNA (e.g., mRNA) vaccine comprises a RNA (e.g., mRNA) polynucleotide encoding a JEV antigenic polypeptide, a WNV antigenic polypeptide, a CHIKV antigenic polypeptide and a ZIKV antigenic polypeptide In some embodiments, a combination RNA (e.g., mRNA) vaccine comprises a RNA (e.g., mRNA) polynucleotide encoding a JEV antigenic polypeptide, a WNV antigenic polypeptide, a CHIKV antigenic polypeptide and a YFV antigenic polypeptide.

In some embodiments, a combination RNA (e.g., mRNA) vaccine comprises a RNA (e.g., mRNA) polynucleotide encoding a JEV antigenic polypeptide, a WNV antigenic polypeptide, a DENV antigenic polypeptide and a ZIKV antigenic polypeptide.

In some embodiments, a combination RNA (e.g., mRNA) vaccine comprises a RNA (e.g., mRNA) polynucleotide encoding a JEV antigenic polypeptide, a WNV antigenic polypeptide, a DENV antigenic polypeptide and a YFV antigenic polypeptide.

In some embodiments, a combination RNA (e.g., mRNA) vaccine comprises a RNA (e.g., mRNA) polynucleotide encoding a JEV antigenic polypeptide, a WNV antigenic polypeptide, a ZIKV antigenic polypeptide and a ZIKV antigenic polypeptide.

In some embodiments, a combination RNA (e.g., mRNA) vaccine comprises a RNA (e.g., mRNA) polynucleotide encoding a JEV antigenic polypeptide, a EEEV antigenic polypeptide, a VEEV antigenic polypeptide and a SINV antigenic polypeptide.

In some embodiments, a combination RNA (e.g., mRNA) vaccine comprises a RNA (e.g., mRNA) polynucleotide encoding a JEV antigenic polypeptide, a EEEV antigenic polypeptide, a VEEV antigenic polypeptide and a CHIKV antigenic polypeptide.

In some embodiments, a combination RNA (e.g., mRNA) vaccine comprises a RNA (e.g., mRNA) polynucleotide encoding a JEV antigenic polypeptide, a EEEV antigenic polypeptide, a VEEV antigenic polypeptide and a DENV antigenic polypeptide.

In some embodiments, a combination RNA (e.g., mRNA) vaccine comprises a RNA (e.g., mRNA) polynucleotide encoding a JEV antigenic polypeptide, a EEEV antigenic polypeptide, a VEEV antigenic polypeptide and a ZIKV antigenic polypeptide.

In some embodiments, a combination RNA (e.g., mRNA) vaccine comprises a RNA (e.g., mRNA) polynucleotide encoding a JEV antigenic polypeptide, a EEEV antigenic polypeptide, a VEEV antigenic polypeptide and a YFV antigenic polypeptide.

In some embodiments, a combination RNA (e.g., mRNA) vaccine comprises a RNA (e.g., mRNA) polynucleotide encoding a JEV antigenic polypeptide, a EEEV antigenic polypeptide, a SINV antigenic polypeptide and a CHIKV antigenic polypeptide.

In some embodiments, a combination RNA (e.g., mRNA) vaccine comprises a RNA (e.g., mRNA) polynucleotide encoding a JEV antigenic polypeptide, a EEEV antigenic polypeptide, a SINV antigenic polypeptide and a DENV antigenic polypeptide.

In some embodiments, a combination RNA (e.g., mRNA) vaccine comprises a RNA (e.g., mRNA) polynucleotide encoding a JEV antigenic polypeptide, a EEEV antigenic polypeptide, a SINV antigenic polypeptide and a ZIKV antigenic polypeptide.

In some embodiments, a combination RNA (e.g., mRNA) vaccine comprises a RNA (e.g., mRNA) polynucleotide encoding a JEV antigenic polypeptide, a EEEV antigenic polypeptide, a SINV antigenic polypeptide and a YFV antigenic polypeptide.

In some embodiments, a combination RNA (e.g., mRNA) vaccine comprises a RNA (e.g., mRNA) polynucleotide encoding a JEV antigenic polypeptide, a EEEV antigenic polypeptide, a CHIKV antigenic polypeptide and a DENV antigenic polypeptide.

In some embodiments, a combination RNA (e.g., mRNA) vaccine comprises a RNA (e.g., mRNA) polynucleotide encoding a JEV antigenic polypeptide, a EEEV antigenic polypeptide, a CHIKV antigenic polypeptide and a ZIKV antigenic polypeptide.

In some embodiments, a combination RNA (e.g., mRNA) vaccine comprises a RNA (e.g., mRNA) polynucleotide encoding a JEV antigenic polypeptide, a EEEV antigenic polypeptide, a CHIKV antigenic polypeptide and a YFV antigenic polypeptide.

In some embodiments, a combination RNA (e.g., mRNA) vaccine comprises a RNA (e.g., mRNA) polynucleotide encoding a JEV antigenic polypeptide, a EEEV antigenic polypeptide, a DENV antigenic polypeptide and a ZIKV antigenic polypeptide.

In some embodiments, a combination RNA (e.g., mRNA) vaccine comprises a RNA (e.g., mRNA) polynucleotide encoding a JEV antigenic polypeptide, a EEEV antigenic polypeptide, a DENV antigenic polypeptide and a YFV antigenic polypeptide.

In some embodiments, a combination RNA (e.g., mRNA) vaccine comprises a RNA (e.g., mRNA) polynucleotide encoding a JEV antigenic polypeptide, a EEEV antigenic polypeptide, a ZIKV antigenic polypeptide and a YFV antigenic polypeptide.

In some embodiments, a combination RNA (e.g., mRNA) vaccine comprises a RNA (e.g., mRNA) polynucleotide encoding a JEV antigenic polypeptide, a VEEV antigenic polypeptide, a SINV antigenic polypeptide and a CHIKV antigenic polypeptide.

In some embodiments, a combination RNA (e.g., mRNA) vaccine comprises a RNA (e.g., mRNA) polynucleotide encoding a JEV antigenic polypeptide, a VEEV antigenic polypeptide, a SINV antigenic polypeptide and a DENV antigenic polypeptide.

In some embodiments, a combination RNA (e.g., mRNA) vaccine comprises a RNA (e.g., mRNA) polynucleotide encoding a JEV antigenic polypeptide, a VEEV antigenic polypeptide, a SINV antigenic polypeptide and a ZIKV antigenic polypeptide.

In some embodiments, a combination RNA (e.g., mRNA) vaccine comprises a RNA (e.g., mRNA) polynucleotide encoding a JEV antigenic polypeptide, a VEEV antigenic polypeptide, a SINV antigenic polypeptide and a YFV antigenic polypeptide.

In some embodiments, a combination RNA (e.g., mRNA) vaccine comprises a RNA (e.g., mRNA) polynucleotide encoding a JEV antigenic polypeptide, a VEEV antigenic polypeptide, a CHIKV antigenic polypeptide and a DENV antigenic polypeptide.

In some embodiments, a combination RNA (e.g., mRNA) vaccine comprises a RNA (e.g., mRNA) polynucleotide encoding a JEV antigenic polypeptide, a VEEV antigenic polypeptide, a CHIKV antigenic polypeptide and a ZIKV antigenic polypeptide.

In some embodiments, a combination RNA (e.g., mRNA) vaccine comprises a RNA (e.g., mRNA) polynucleotide encoding a JEV antigenic polypeptide, a VEEV antigenic polypeptide, a CHIKV antigenic polypeptide and a YFV antigenic polypeptide.

In some embodiments, a combination RNA (e.g., mRNA) vaccine comprises a RNA (e.g., mRNA) polynucleotide encoding a JEV antigenic polypeptide, a VEEV antigenic polypeptide, a DENV antigenic polypeptide and a ZIKV antigenic polypeptide.

In some embodiments, a combination RNA (e.g., mRNA) vaccine comprises a RNA (e.g., mRNA) polynucleotide encoding a JEV antigenic polypeptide, a VEEV antigenic polypeptide, a DENV antigenic polypeptide and a YFV antigenic polypeptide.

In some embodiments, a combination RNA (e.g., mRNA) vaccine comprises a RNA (e.g., mRNA) polynucleotide encoding a JEV antigenic polypeptide, a VEEV antigenic polypeptide, a ZIKV antigenic polypeptide and a YFV antigenic polypeptide.

In some embodiments, a combination RNA (e.g., mRNA) vaccine comprises a RNA (e.g., mRNA) polynucleotide encoding a JEV antigenic polypeptide, a SINV antigenic polypeptide, a CHIKV antigenic polypeptide and a DENV antigenic polypeptide.

In some embodiments, a combination RNA (e.g., mRNA) vaccine comprises a RNA (e.g., mRNA) polynucleotide encoding a JEV antigenic polypeptide, a SINV antigenic polypeptide, a CHIKV antigenic polypeptide and a ZIKV antigenic polypeptide.

In some embodiments, a combination RNA (e.g., mRNA) vaccine comprises a RNA (e.g., mRNA) polynucleotide encoding a JEV antigenic polypeptide, a SINV antigenic polypeptide, a CHIKV antigenic polypeptide and a YFV antigenic polypeptide.

In some embodiments, a combination RNA (e.g., mRNA) vaccine comprises a RNA (e.g., mRNA) polynucleotide encoding a JEV antigenic polypeptide, a SINV antigenic polypeptide, a DENV antigenic polypeptide and a ZIKV antigenic polypeptide.

In some embodiments, a combination RNA (e.g., mRNA) vaccine comprises a RNA (e.g., mRNA) polynucleotide encoding a JEV antigenic polypeptide, a SINV antigenic polypeptide, a DENV antigenic polypeptide and a YFV antigenic polypeptide.

In some embodiments, a combination RNA (e.g., mRNA) vaccine comprises a RNA (e.g., mRNA) polynucleotide encoding a JEV antigenic polypeptide, a SINV antigenic polypeptide, a ZIKV antigenic polypeptide and a YFV antigenic polypeptide.

In some embodiments, a combination RNA (e.g., mRNA) vaccine comprises a RNA (e.g., mRNA) polynucleotide encoding a JEV antigenic polypeptide, a CHIKV antigenic polypeptide, a DENV antigenic polypeptide and a ZIKV antigenic polypeptide.

In some embodiments, a combination RNA (e.g., mRNA) vaccine comprises a RNA (e.g., mRNA) polynucleotide encoding a JEV antigenic polypeptide, a CHIKV antigenic polypeptide, a DENV antigenic polypeptide and a YFV antigenic polypeptide.

In some embodiments, a combination RNA (e.g., mRNA) vaccine comprises a RNA (e.g., mRNA) polynucleotide encoding a JEV antigenic polypeptide, a CHIKV antigenic polypeptide, a ZIKV antigenic polypeptide and a YFV antigenic polypeptide.

In some embodiments, a combination RNA (e.g., mRNA) vaccine comprises a RNA (e.g., mRNA) polynucleotide encoding a JEV antigenic polypeptide, a DENV antigenic polypeptide, a ZIKV antigenic polypeptide and a YFV antigenic polypeptide.

In some embodiments, a combination RNA (e.g., mRNA) vaccine comprises a RNA (e.g., mRNA) polynucleotide encoding a WNV antigenic polypeptide, a EEEV antigenic polypeptide, a VEEV antigenic polypeptide and a SINV antigenic polypeptide.

In some embodiments, a combination RNA (e.g., mRNA) vaccine comprises a RNA (e.g., mRNA) polynucleotide encoding a WNV antigenic polypeptide, a EEEV antigenic polypeptide, a VEEV antigenic polypeptide and a CHIKV antigenic polypeptide.

In some embodiments, a combination RNA (e.g., mRNA) vaccine comprises a RNA (e.g., mRNA) polynucleotide encoding a WNV antigenic polypeptide, a EEEV antigenic polypeptide, a VEEV antigenic polypeptide and a DENV antigenic polypeptide.

In some embodiments, a combination RNA (e.g., mRNA) vaccine comprises a RNA (e.g., mRNA) polynucleotide encoding a WNV antigenic polypeptide, a EEEV antigenic polypeptide, a VEEV antigenic polypeptide and a ZIKV antigenic polypeptide.

In some embodiments, a combination RNA (e.g., mRNA) vaccine comprises a RNA (e.g., mRNA) polynucleotide encoding a WNV antigenic polypeptide, a EEEV antigenic polypeptide, a VEEV antigenic polypeptide and a YFV antigenic polypeptide.

In some embodiments, a combination RNA (e.g., mRNA) vaccine comprises a RNA (e.g., mRNA) polynucleotide encoding a WNV antigenic polypeptide, a EEEV antigenic polypeptide, a SINV antigenic polypeptide and a CHIKV antigenic polypeptide.

In some embodiments, a combination RNA (e.g., mRNA) vaccine comprises a RNA (e.g., mRNA) polynucleotide encoding a WNV antigenic polypeptide, a EEEV antigenic polypeptide, a SINV antigenic polypeptide and a DENV antigenic polypeptide.

In some embodiments, a combination RNA (e.g., mRNA) vaccine comprises a RNA (e.g., mRNA) polynucleotide encoding a WNV antigenic polypeptide, a EEEV antigenic polypeptide, a SINV antigenic polypeptide and a ZIKV antigenic polypeptide.

In some embodiments, a combination RNA (e.g., mRNA) vaccine comprises a RNA (e.g., mRNA) polynucleotide encoding a WNV antigenic polypeptide, a EEEV antigenic polypeptide, a SINV antigenic polypeptide and a YFV antigenic polypeptide.

In some embodiments, a combination RNA (e.g., mRNA) vaccine comprises a RNA (e.g., mRNA) polynucleotide encoding a WNV antigenic polypeptide, a EEEV antigenic polypeptide, a CHIKV antigenic polypeptide and a DENV antigenic polypeptide.

In some embodiments, a combination RNA (e.g., mRNA) vaccine comprises a RNA (e.g., mRNA) polynucleotide encoding a WNV antigenic polypeptide, a EEEV antigenic polypeptide, a CHIKV antigenic polypeptide and a ZIKV antigenic polypeptide.

In some embodiments, a combination RNA (e.g., mRNA) vaccine comprises a RNA (e.g., mRNA) polynucleotide encoding a WNV antigenic polypeptide, a EEEV antigenic polypeptide, a CHIKV antigenic polypeptide and a YFV antigenic polypeptide.

In some embodiments, a combination RNA (e.g., mRNA) vaccine comprises a RNA (e.g., mRNA) polynucleotide encoding a WNV antigenic polypeptide, a EEEV antigenic polypeptide, a DENV antigenic polypeptide and a ZIKV antigenic polypeptide.

In some embodiments, a combination RNA (e.g., mRNA) vaccine comprises a RNA (e.g., mRNA) polynucleotide encoding a WNV antigenic polypeptide, a EEEV antigenic polypeptide, a DENV antigenic polypeptide and a YFV antigenic polypeptide.

In some embodiments, a combination RNA (e.g., mRNA) vaccine comprises a RNA (e.g., mRNA) polynucleotide encoding a WNV antigenic polypeptide, a EEEV antigenic polypeptide, a ZIKV antigenic polypeptide and a YFV antigenic polypeptide.

In some embodiments, a combination RNA (e.g., mRNA) vaccine comprises a RNA (e.g., mRNA) polynucleotide encoding a WNV antigenic polypeptide, a VEEV antigenic polypeptide, a SINV antigenic polypeptide and a CHIKV antigenic polypeptide.

In some embodiments, a combination RNA (e.g., mRNA) vaccine comprises a RNA (e.g., mRNA) polynucleotide encoding a WNV antigenic polypeptide, a VEEV antigenic polypeptide, a SINV antigenic polypeptide and a DENV antigenic polypeptide.

In some embodiments, a combination RNA (e.g., mRNA) vaccine comprises a RNA (e.g., mRNA) polynucleotide encoding a WNV antigenic polypeptide, a VEEV antigenic polypeptide, a SINV antigenic polypeptide and a ZIKV antigenic polypeptide.

In some embodiments, a combination RNA (e.g., mRNA) vaccine comprises a RNA (e.g., mRNA) polynucleotide encoding a WNV antigenic polypeptide, a VEEV antigenic polypeptide, a SINV antigenic polypeptide and a YFV antigenic polypeptide.

In some embodiments, a combination RNA (e.g., mRNA) vaccine comprises a RNA (e.g., mRNA) polynucleotide encoding a WNV antigenic polypeptide, a VEEV antigenic polypeptide, a CHIKV antigenic polypeptide and a DENV antigenic polypeptide.

In some embodiments, a combination RNA (e.g., mRNA) vaccine comprises a RNA (e.g., mRNA) polynucleotide encoding a WNV antigenic polypeptide, a VEEV antigenic polypeptide, a CHIKV antigenic polypeptide and a ZIKV antigenic polypeptide.

In some embodiments, a combination RNA (e.g., mRNA) vaccine comprises a RNA (e.g., mRNA) polynucleotide encoding a WNV antigenic polypeptide, a VEEV antigenic polypeptide, a CHIKV antigenic polypeptide and a YFV antigenic polypeptide.

In some embodiments, a combination RNA (e.g., mRNA) vaccine comprises a RNA (e.g., mRNA) polynucleotide encoding a WNV antigenic polypeptide, a VEEV antigenic polypeptide, a DENV antigenic polypeptide and a ZIKV antigenic polypeptide.

In some embodiments, a combination RNA (e.g., mRNA) vaccine comprises a RNA (e.g., mRNA) polynucleotide encoding a WNV antigenic polypeptide, a VEEV antigenic polypeptide, a DENV antigenic polypeptide and a YFV antigenic polypeptide.

In some embodiments, a combination RNA (e.g., mRNA) vaccine comprises a RNA (e.g., mRNA) polynucleotide encoding a WNV antigenic polypeptide, a VEEV antigenic polypeptide, a ZIKV antigenic polypeptide and a YFV antigenic polypeptide.

In some embodiments, a combination RNA (e.g., mRNA) vaccine comprises a RNA (e.g., mRNA) polynucleotide encoding a WNV antigenic polypeptide, a SINV antigenic polypeptide, a CHIKV antigenic polypeptide and a DENV antigenic polypeptide.

In some embodiments, a combination RNA (e.g., mRNA) vaccine comprises a RNA (e.g., mRNA) polynucleotide encoding a WNV antigenic polypeptide, a SINV antigenic polypeptide, a CHIKV antigenic polypeptide and a ZIKV antigenic polypeptide.

In some embodiments, a combination RNA (e.g., mRNA) vaccine comprises a RNA (e.g., mRNA) polynucleotide encoding a WNV antigenic polypeptide, a SINV antigenic polypeptide, a CHIKV antigenic polypeptide and a YFV antigenic polypeptide.

In some embodiments, a combination RNA (e.g., mRNA) vaccine comprises a RNA (e.g., mRNA) polynucleotide encoding a WNV antigenic polypeptide, a SINV antigenic polypeptide, a DENV antigenic polypeptide and a ZIKV antigenic polypeptide.

In some embodiments, a combination RNA (e.g., mRNA) vaccine comprises a RNA (e.g., mRNA) polynucleotide encoding a WNV antigenic polypeptide, a SINV antigenic polypeptide, a DENV antigenic polypeptide and a YFV antigenic polypeptide.

In some embodiments, a combination RNA (e.g., mRNA) vaccine comprises a RNA (e.g., mRNA) polynucleotide encoding a WNV antigenic polypeptide, a SINV antigenic polypeptide, a ZIKV antigenic polypeptide and a YFV antigenic polypeptide.

In some embodiments, a combination RNA (e.g., mRNA) vaccine comprises a RNA (e.g., mRNA) polynucleotide encoding a WNV antigenic polypeptide, a CHIKV antigenic polypeptide, a DENV antigenic polypeptide and a ZIKV antigenic polypeptide.

In some embodiments, a combination RNA (e.g., mRNA) vaccine comprises a RNA (e.g., mRNA) polynucleotide encoding a WNV antigenic polypeptide, a CHIKV antigenic polypeptide, a DENV antigenic polypeptide and a YFV antigenic polypeptide.

In some embodiments, a combination RNA (e.g., mRNA) vaccine comprises a RNA (e.g., mRNA) polynucleotide encoding a WNV antigenic polypeptide, a CHIKV antigenic polypeptide, a ZIKV antigenic polypeptide and a YFV antigenic polypeptide.

In some embodiments, a combination RNA (e.g., mRNA) vaccine comprises a RNA (e.g., mRNA) polynucleotide encoding a WNV antigenic polypeptide, a DENV antigenic polypeptide, a ZIKV antigenic polypeptide and a YFV antigenic polypeptide.

In some embodiments, a combination RNA (e.g., mRNA) vaccine comprises a RNA (e.g., mRNA) polynucleotide encoding a EEEV antigenic polypeptide, a VEEV antigenic polypeptide, a SINV antigenic polypeptide and a CHIKV antigenic polypeptide.

In some embodiments, a combination RNA (e.g., mRNA) vaccine comprises a RNA (e.g., mRNA) polynucleotide encoding a EEEV antigenic polypeptide, a VEEV antigenic polypeptide, a SINV antigenic polypeptide and a DENV antigenic polypeptide.

In some embodiments, a combination RNA (e.g., mRNA) vaccine comprises a RNA (e.g., mRNA) polynucleotide encoding a EEEV antigenic polypeptide, a VEEV antigenic polypeptide, a SINV antigenic polypeptide and a ZIKV antigenic polypeptide.

In some embodiments, a combination RNA (e.g., mRNA) vaccine comprises a RNA (e.g., mRNA) polynucleotide encoding a EEEV antigenic polypeptide, a VEEV antigenic polypeptide, a SINV antigenic polypeptide and a YFV antigenic polypeptide.

In some embodiments, a combination RNA (e.g., mRNA) vaccine comprises a RNA (e.g., mRNA) polynucleotide encoding a EEEV antigenic polypeptide, a VEEV antigenic polypeptide, a CHIKV antigenic polypeptide and a DENV antigenic polypeptide.

In some embodiments, a combination RNA (e.g., mRNA) vaccine comprises a RNA (e.g., mRNA) polynucleotide encoding a EEEV antigenic polypeptide, a VEEV antigenic polypeptide, a CHIKV antigenic polypeptide and a ZIKV antigenic polypeptide.

In some embodiments, a combination RNA (e.g., mRNA) vaccine comprises a RNA (e.g., mRNA) polynucleotide encoding a EEEV antigenic polypeptide, a VEEV antigenic polypeptide, a CHIKV antigenic polypeptide and a YFV antigenic polypeptide.

In some embodiments, a combination RNA (e.g., mRNA) vaccine comprises a RNA (e.g., mRNA) polynucleotide encoding a EEEV antigenic polypeptide, a VEEV antigenic polypeptide, a DENV antigenic polypeptide and a ZIKV antigenic polypeptide.

In some embodiments, a combination RNA (e.g., mRNA) vaccine comprises a RNA (e.g., mRNA) polynucleotide encoding a EEEV antigenic polypeptide, a VEEV antigenic polypeptide, a DENV antigenic polypeptide and a YFV antigenic polypeptide.

In some embodiments, a combination RNA (e.g., mRNA) vaccine comprises a RNA (e.g., mRNA) polynucleotide encoding a EEEV antigenic polypeptide, a VEEV antigenic polypeptide, a ZIKV antigenic polypeptide and a YFV antigenic polypeptide.

In some embodiments, a combination RNA (e.g., mRNA) vaccine comprises a RNA (e.g., mRNA) polynucleotide encoding a EEEV antigenic polypeptide, a SINV antigenic polypeptide, a CHIKV antigenic polypeptide and a DENV antigenic polypeptide.

In some embodiments, a combination RNA (e.g., mRNA) vaccine comprises a RNA (e.g., mRNA) polynucleotide encoding a EEEV antigenic polypeptide, a SINV antigenic polypeptide, a CHIKV antigenic polypeptide and a ZIKV antigenic polypeptide.

In some embodiments, a combination RNA (e.g., mRNA) vaccine comprises a RNA (e.g., mRNA) polynucleotide encoding a EEEV antigenic polypeptide, a SINV antigenic polypeptide, a CHIKV antigenic polypeptide and a YFV antigenic polypeptide.

In some embodiments, a combination RNA (e.g., mRNA) vaccine comprises a RNA (e.g., mRNA) polynucleotide encoding a EEEV antigenic polypeptide, a SINV antigenic polypeptide, a DENV antigenic polypeptide and a ZIKV antigenic polypeptide.

In some embodiments, a combination RNA (e.g., mRNA) vaccine comprises a RNA (e.g., mRNA) polynucleotide encoding a EEEV antigenic polypeptide, a SINV antigenic polypeptide, a DENV antigenic polypeptide and a YFV antigenic polypeptide.

In some embodiments, a combination RNA (e.g., mRNA) vaccine comprises a RNA (e.g., mRNA) polynucleotide encoding a EEEV antigenic polypeptide, a SINV antigenic polypeptide, a ZIKV antigenic polypeptide and a YFV antigenic polypeptide.

In some embodiments, a combination RNA (e.g., mRNA) vaccine comprises a RNA (e.g., mRNA) polynucleotide encoding a EEEV antigenic polypeptide, a SINV antigenic polypeptide, a DENV antigenic polypeptide and a ZIKV antigenic polypeptide.

In some embodiments, a combination RNA (e.g., mRNA) vaccine comprises a RNA (e.g., mRNA) polynucleotide encoding a EEEV antigenic polypeptide, a SINV antigenic polypeptide, a DENV antigenic polypeptide and a YFV antigenic polypeptide.

In some embodiments, a combination RNA (e.g., mRNA) vaccine comprises a RNA (e.g., mRNA) polynucleotide encoding a EEEV antigenic polypeptide, a SINV antigenic polypeptide, a ZIKV antigenic polypeptide and a YFV antigenic polypeptide.

In some embodiments, a combination RNA (e.g., mRNA) vaccine comprises a RNA (e.g., mRNA) polynucleotide encoding VEEV antigenic polypeptide, a SINV antigenic polypeptide, a CHIKV antigenic polypeptide and a DENV antigenic polypeptide In some embodiments, a combination RNA (e.g., mRNA) vaccine comprises a RNA (e.g., mRNA) polynucleotide encoding VEEV antigenic polypeptide, a SINV antigenic polypeptide, a CHIKV antigenic polypeptide and a ZIKV antigenic polypeptide.

In some embodiments, a combination RNA (e.g., mRNA) vaccine comprises a RNA (e.g., mRNA) polynucleotide encoding VEEV antigenic polypeptide, a SINV antigenic polypeptide, a CHIKV antigenic polypeptide and a YFV antigenic polypeptide.

In some embodiments, a combination RNA (e.g., mRNA) vaccine comprises a RNA (e.g., mRNA) polynucleotide encoding VEEV antigenic polypeptide, a SINV antigenic polypeptide, a DENV antigenic polypeptide and a ZIKV antigenic polypeptide.

In some embodiments, a combination RNA (e.g., mRNA) vaccine comprises a RNA (e.g., mRNA) polynucleotide encoding VEEV antigenic polypeptide, a SINV antigenic polypeptide, a DENV antigenic polypeptide and a YFV antigenic polypeptide.

In some embodiments, a combination RNA (e.g., mRNA) vaccine comprises a RNA (e.g., mRNA) polynucleotide encoding VEEV antigenic polypeptide, a SINV antigenic polypeptide, a ZIKV antigenic polypeptide and a YFV antigenic polypeptide.

In some embodiments, a combination RNA (e.g., mRNA) vaccine comprises a RNA (e.g., mRNA) polynucleotide encoding VEEV antigenic polypeptide, a CHIKV antigenic polypeptide, a DENV antigenic polypeptide and a ZIKV antigenic polypeptide.

In some embodiments, a combination RNA (e.g., mRNA) vaccine comprises a RNA (e.g., mRNA) polynucleotide encoding VEEV antigenic polypeptide, a CHIKV antigenic polypeptide, a DENV antigenic polypeptide and a YFV antigenic polypeptide.

In some embodiments, a combination RNA (e.g., mRNA) vaccine comprises a RNA (e.g., mRNA) polynucleotide encoding VEEV antigenic polypeptide, a CHIKV antigenic polypeptide, a ZIKV antigenic polypeptide and a YFV antigenic polypeptide.

In some embodiments, a combination RNA (e.g., mRNA) vaccine comprises a RNA (e.g., mRNA) polynucleotide encoding VEEV antigenic polypeptide, a DENV antigenic polypeptide, a ZIKV antigenic polypeptide and a YFV antigenic polypeptide.

In some embodiments, a combination RNA (e.g., mRNA) vaccine comprises a RNA (e.g., mRNA) polynucleotide encoding SINV antigenic polypeptide, a CHIKV antigenic polypeptide, a DENV antigenic polypeptide and a ZIKV antigenic polypeptide.

In some embodiments, a combination RNA (e.g., mRNA) vaccine comprises a RNA (e.g., mRNA) polynucleotide encoding SINV antigenic polypeptide, a CHIKV antigenic polypeptide, a DENV antigenic polypeptide and a YFV antigenic polypeptide.

In some embodiments, a combination RNA (e.g., mRNA) vaccine comprises a RNA (e.g., mRNA) polynucleotide encoding SINV antigenic polypeptide, a CHIKV antigenic polypeptide, a ZIKV antigenic polypeptide and a YFV antigenic polypeptide.

In some embodiments, a combination RNA (e.g., mRNA) vaccine comprises a RNA (e.g., mRNA) polynucleotide encoding SINV antigenic polypeptide, a DENV antigenic polypeptide, a ZIKV antigenic polypeptide and a YFV antigenic polypeptide.

In some embodiments, a combination RNA (e.g., mRNA) vaccine comprises a RNA (e.g., mRNA) polynucleotide encoding CHIKV antigenic polypeptide, a DENV antigenic polypeptide, a ZIKV antigenic polypeptide and a YFV antigenic polypeptide.

In some embodiments, a combination RNA (e.g., mRNA) vaccine comprises a RNA (e.g., mRNA) polynucleotide encoding a JEV antigenic polypeptide, a WNV antigenic polypeptide, a EEEV antigenic polypeptide, a VEEV antigenic polypeptide, a SINV antigenic polypeptide, a CHIKV antigenic polypeptide, a DENV antigenic polypeptide, a ZIKV antigenic polypeptide and a YFV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a WNV antigenic polypeptide, a EEEV antigenic polypeptide, a VEEV antigenic polypeptide, a SINV antigenic polypeptide, a CHIKV antigenic polypeptide, a DENV antigenic polypeptide, a ZIKV antigenic polypeptide and a YFV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a JEV antigenic polypeptide, a EEEV antigenic polypeptide, a VEEV antigenic polypeptide, a SINV antigenic polypeptide, a CHIKV antigenic polypeptide, a DENV antigenic polypeptide, a ZIKV antigenic polypeptide and a YFV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a JEV antigenic polypeptide, a WNV antigenic polypeptide, a VEEV antigenic polypeptide, a SINV antigenic polypeptide, a CHIKV antigenic polypeptide, a DENV antigenic polypeptide, a ZIKV antigenic polypeptide and a YFV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a JEV antigenic polypeptide, a WNV antigenic polypeptide, a EEEV antigenic polypeptide, a SINV antigenic polypeptide, a CHIKV antigenic polypeptide, a DENV antigenic polypeptide, a ZIKV antigenic polypeptide and a YFV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a JEV antigenic polypeptide, a WNV antigenic polypeptide, a EEEV antigenic polypeptide, a VEEV antigenic polypeptide, a CHIKV antigenic polypeptide, a DENV antigenic polypeptide, a ZIKV antigenic polypeptide and a YFV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a JEV antigenic polypeptide, a WNV antigenic polypeptide, a EEEV antigenic polypeptide, a VEEV antigenic polypeptide, a SINV antigenic polypeptide, a DENV antigenic polypeptide, a ZIKV antigenic polypeptide and a YFV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a JEV antigenic polypeptide, a WNV antigenic polypeptide, a EEEV antigenic polypeptide, a VEEV antigenic polypeptide, a SINV antigenic polypeptide, a CHIKV antigenic polypeptide, a ZIKV antigenic polypeptide and a YFV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a JEV antigenic polypeptide, a WNV antigenic polypeptide, a EEEV antigenic polypeptide, a VEEV antigenic polypeptide, a SINV antigenic polypeptide, a CHIKV antigenic polypeptide, a DENV antigenic polypeptide, and a YFV antigenic polypeptide.

In some embodiments, a combination RNA (e.g., mRNA) vaccine comprises a RNA (e.g., mRNA) polynucleotide encoding a Malaria (e.g., *P. falciparum, P. vivax, P. malariae* and/or *P. ovale*) antigenic polypeptide, a JEV antigenic polypeptide, a WNV antigenic polypeptide, a EEEV antigenic polypeptide, a VEEV antigenic polypeptide, a SINV antigenic polypeptide, a CHIKV antigenic polypeptide, a DENV antigenic polypeptide, and a ZIKV antigenic polypeptide.

In some embodiments, a combination RNA (e.g., mRNA) vaccine comprises a RNA (e.g., mRNA) polynucleotide encoding a JEV antigenic polypeptide, a WNV antigenic polypeptide, a EEEV antigenic polypeptide, a VEEV antigenic polypeptide, and a SINV antigenic polypeptide.

In some embodiments, a combination RNA (e.g., mRNA) vaccine comprises a RNA (e.g., mRNA) polynucleotide encoding a JEV antigenic polypeptide, a WNV antigenic polypeptide, a EEEV antigenic polypeptide, a VEEV antigenic polypeptide, a SINV antigenic polypeptide, and a CHIKV antigenic polypeptide.

In some embodiments, a combination RNA (e.g., mRNA) vaccine comprises a RNA (e.g., mRNA) polynucleotide encoding a JEV antigenic polypeptide, a WNV antigenic polypeptide, a EEEV antigenic polypeptide, a SINV antigenic polypeptide, and a CHIKV antigenic polypeptide.

In some embodiments, a combination RNA (e.g., mRNA) vaccine comprises a RNA (e.g., mRNA) polynucleotide encoding a JEV antigenic polypeptide, a WNV antigenic polypeptide, a EEEV antigenic polypeptide, a SINV antigenic polypeptide, a CHIKV antigenic polypeptide and a DENV antigenic polypeptide.

In some embodiments, a combination RNA (e.g., mRNA) vaccine comprises at least two RNA (e.g., mRNA) polynucleotides selected from Malaria (e.g., *P. falciparum, P. vivax, P. malariae* and/or *P. ovale*) antigenic polypeptides, JEV antigenic polypeptides, WNV antigenic polypeptides, EEEV antigenic polypeptides, VEEV antigenic polypeptides, SINV antigenic polypeptides, CHIKV antigenic polypeptides, DENV antigenic polypeptides, ZIKV antigenic polypeptides and a YFV antigenic polypeptides.

In some embodiments, a combination RNA (e.g., mRNA) vaccine comprises at least three RNA (e.g., mRNA) polynucleotides selected from Malaria (e.g., *P. falciparum, P. vivax, P. malariae* and/or *P. ovale*) antigenic polypeptides, JEV antigenic polypeptides, WNV antigenic polypeptides, EEEV antigenic polypeptides, VEEV antigenic polypeptides, SINV antigenic polypeptides, CHIKV antigenic polypeptides, DENV antigenic polypeptides, ZIKV antigenic polypeptides and a YFV antigenic polypeptides.

In some embodiments, a combination RNA (e.g., mRNA) vaccine comprises at least four RNA (e.g., mRNA) polynucleotides selected from Malaria (e.g., *P. falciparum, P. vivax, P. malariae* and/or *P. ovale*) antigenic polypeptides, JEV antigenic polypeptides, WNV antigenic polypeptides, EEEV antigenic polypeptides, VEEV antigenic polypeptides, SINV antigenic polypeptides, CHIKV antigenic polypeptides, DENV antigenic polypeptides, ZIKV antigenic polypeptides and a YFV antigenic polypeptides.

In some embodiments, a combination RNA (e.g., mRNA) vaccine comprises at least five RNA (e.g., mRNA) polynucleotides selected from Malaria (e.g., *P. falciparum, P. vivax, P. malariae* and/or *P. ovale*) antigenic polypeptides, JEV antigenic polypeptides, WNV antigenic polypeptides, EEEV antigenic polypeptides, VEEV antigenic polypeptides, SINV antigenic polypeptides, CHIKV antigenic polypeptides, DENV antigenic polypeptides, ZIKV antigenic polypeptides and a YFV antigenic polypeptides.

In some embodiments, a combination RNA (e.g., mRNA) vaccine comprises at least six RNA (e.g., mRNA) polynucleotides selected from Malaria (e.g., *P. falciparum, P. vivax, P. malariae* and/or *P. ovale*) antigenic polypeptides, JEV antigenic polypeptides, WNV antigenic polypeptides, EEEV antigenic polypeptides, VEEV antigenic polypeptides, SINV antigenic polypeptides, CHIKV antigenic polypeptides, DENV antigenic polypeptides, ZIKV antigenic polypeptides and a YFV antigenic polypeptides.

In some embodiments, a combination RNA (e.g., mRNA) vaccine comprises at least seven RNA (e.g., mRNA) polynucleotides selected from Malaria (e.g., *P. falciparum, P. vivax, P. malariae* and/or *P. ovale*) antigenic polypeptides, JEV antigenic polypeptides, WNV antigenic polypeptides, EEEV antigenic polypeptides, VEEV antigenic polypeptides, SINV antigenic polypeptides, CHIKV antigenic polypeptides, DENV antigenic polypeptides, ZIKV antigenic polypeptides and a YFV antigenic polypeptides.

In some embodiments, a combination RNA (e.g., mRNA) vaccine comprises at least eight RNA (e.g., mRNA) polynucleotides selected from Malaria (e.g., *P. falciparum, P. vivax, P. malariae* and/or *P. ovale*) antigenic polypeptides, JEV antigenic polypeptides, WNV antigenic polypeptides, EEEV antigenic polypeptides, VEEV antigenic polypeptides, SINV antigenic polypeptides, CHIKV antigenic polypeptides, DENV antigenic polypeptides, ZIKV antigenic polypeptides and a YFV antigenic polypeptides.

In some embodiments, a combination RNA (e.g., mRNA) vaccine comprises at least nine RNA (e.g., mRNA) polynucleotides selected from Malaria (e.g., *P. falciparum, P. vivax, P. malariae* and/or *P. ovale*) antigenic polypeptides, JEV antigenic polypeptides, WNV antigenic polypeptides, EEEV antigenic polypeptides, VEEV antigenic polypeptides, SINV antigenic polypeptides, CHIKV antigenic polypeptides, DENV antigenic polypeptides, ZIKV antigenic polypeptides and a YFV antigenic polypeptides.

In some embodiments, a combination RNA (e.g., mRNA) vaccine comprises at least ten RNA (e.g., mRNA) polynucleotides selected from Malaria (e.g., *P. falciparum, P. vivax, P. malariae* and/or *P. ovale*) antigenic polypeptides, JEV antigenic polypeptides, WNV antigenic polypeptides, EEEV antigenic polypeptides, VEEV antigenic polypeptides, SINV antigenic polypeptides, CHIKV antigenic polypeptides, DENV antigenic polypeptides, ZIKV antigenic polypeptides and a YFV antigenic polypeptides.

Additional combination vaccines are encompassed by the following numbered paragraphs:

1. A combination vaccine comprising at least one RNA (e.g., mRNA) encoding at least one tropical disease antigenic polypeptide.
2. The combination vaccine of paragraph 1, wherein the at least one polypeptide is at least one Malaria (e.g., *P. falciparum, P. vivax, P. malariae* and/or *P. ovale*) antigenic polypeptide.
3. The combination vaccine of paragraph 1 or 2, wherein the at least one polypeptide is at least one JEV antigenic polypeptide.
4. The combination vaccine of any one of paragraphs 1-3, wherein the at least one polypeptide is at least one WNV antigenic polypeptide.
5. The combination vaccine of any one of paragraphs 1-4, wherein the at least one polypeptide is at least one EEEV antigenic polypeptide.
6. The combination vaccine of any one of paragraphs 1-5, wherein the at least one polypeptide is at least one VEEV antigenic polypeptide.
7. The combination vaccine of any one of paragraphs 1-6, wherein the at least one polypeptide is at least one SINV antigenic polypeptide.
8. The combination vaccine of any one of paragraphs 1-7, wherein the at least one polypeptide is at least one CHIKV antigenic polypeptide.
9. The combination vaccine of any one of paragraphs 1-8, wherein the at least one polypeptide is at least one DENV antigenic polypeptide.
10. The combination vaccine of any one of paragraphs 1-9, wherein the at least one polypeptide is at least one ZIKV antigenic polypeptide.
11. The combination vaccine of any one of paragraphs 1-10, wherein the at least one polypeptide is at least one YFV antigenic polypeptide.

It has been discovered that the mRNA vaccines described herein are superior to current vaccines in several ways. First, the lipid nanoparticle (LNP) delivery is superior to other formulations including a protamine base approach described in the literature and no additional adjuvants are to be necessary. The use of LNPs enables the effective delivery of chemically modified or unmodified mRNA vaccines. Additionally it has been demonstrated herein that both modified and unmodified LNP formulated mRNA vaccines were superior to conventional vaccines by a significant degree. In some embodiments the mRNA vaccines of the invention are superior to conventional vaccines by a factor of at least 10 fold, 20 fold, 40 fold, 50 fold, 100 fold, 500 fold or 1,000 fold.

Although attempts have been made to produce functional RNA vaccines, including mRNA vaccines and self-replicating RNA vaccines, the therapeutic efficacy of these RNA vaccines has not yet been fully established. Quite surprisingly, the inventors have discovered, according to aspects of the invention a class of formulations for delivering mRNA vaccines in vivo that results in significantly enhanced, and in many respects synergistic, immune responses including enhanced antigen generation and functional antibody production with neutralization capability. These results can be achieved even when significantly lower doses of the mRNA are administered in comparison with mRNA doses used in other classes of lipid based formulations. The formulations of the invention have demonstrated significant unexpected in vivo immune responses sufficient to establish the efficacy of functional mRNA vaccines as prophylactic and therapeutic agents. Additionally, self-replicating RNA vaccines rely on viral replication pathways to deliver enough RNA to a cell to produce an immunogenic response. The formulations of the invention do not require viral replication to produce enough protein to result in a strong immune response. Thus, the mRNA of the invention are not self-replicating RNA and do not include components necessary for viral replication.

The invention involves, in some aspects, the surprising finding that lipid nanoparticle (LNP) formulations significantly enhance the effectiveness of mRNA vaccines, including chemically modified and unmodified mRNA vaccines. The efficacy of mRNA vaccines formulated in LNP was examined in vivo using several distinct antigens. The results presented herein demonstrate the unexpected superior efficacy of the mRNA vaccines formulated in LNP over other commercially available vaccines.

In addition to providing an enhanced immune response, the formulations of the invention generate a more rapid immune response with fewer doses of antigen than other vaccines tested. The mRNA-LNP formulations of the invention also produce quantitatively and qualitatively better immune responses than vaccines formulated in a different carriers.

The data described herein demonstrate that the formulations of the invention produced significant unexpected improvements over existing antigen vaccines. Additionally, the mRNA-LNP formulations of the invention are superior to other vaccines even when the dose of mRNA is lower than other vaccines.

The LNP used in the studies described herein has been used previously to deliver siRNA in various animal models as well as in humans. In view of the observations made in association with the siRNA delivery of LNP formulations, the fact that LNP is useful in vaccines is quite surprising. It has been observed that therapeutic delivery of siRNA formulated in LNP causes an undesirable inflammatory response associated with a transient IgM response, typically leading to a reduction in antigen production and a compromised immune response. In contrast to the findings observed with siRNA, the LNP-mRNA formulations of the invention are demonstrated herein to generate enhanced IgG levels, sufficient for prophylactic and therapeutic methods rather than transient IgM responses.

Nucleic Acids/Polynucleotides

Tropical disease vaccines, as provided herein, comprise at least one (one or more) ribonucleic acid (RNA) (e.g., mRNA) polynucleotide having an open reading frame encoding at least one Malaria (e.g., *P. falciparum, P. vivax, P. malariae* and/or *P. ovale*), JEV, WNV, EEEV, VEEV, SINV, CHIKV, DENV, ZIKV and/or YFV antigenic polypeptide. The term "nucleic acid" includes any compound and/or substance that comprises a polymer of nucleotides (nucleotide monomer). These polymers are referred to as polynucleotides. Thus, the terms "nucleic acid" and "polynucleotide" are used interchangeably.

Nucleic acids may be or may include, for example, ribonucleic acids (RNAs), deoxyribonucleic acids (DNAs), threose nucleic acids (TNAs), glycol nucleic acids (GNAs), peptide nucleic acids (PNAs), locked nucleic acids (LNAs, including LNA having a β-D-ribo configuration, α-LNA having an α-L-ribo configuration (a diastereomer of LNA), 2'-amino-LNA having a 2'-amino functionalization, and 2'-amino-α-LNA having a 2'-amino functionalization), ethylene nucleic acids (ENA), cyclohexenyl nucleic acids (CeNA) or chimeras or combinations thereof.

In some embodiments, polynucleotides of the present disclosure function as messenger RNA (mRNA). "Messenger RNA" (mRNA) refers to any polynucleotide that encodes a (at least one) polypeptide (a naturally-occurring, non-naturally-occurring, or modified polymer of amino acids) and can be translated to produce the encoded polypeptide in vitro, in vivo, in situ or ex vivo. The skilled artisan will appreciate that, except where otherwise noted, polynucleotide sequences set forth in the instant application will recite "T"s in a representative DNA sequence but where the sequence represents RNA (e.g., mRNA), the "T"s would be substituted for "U"s. Thus, any of the RNA polynucleotides encoded by a DNA identified by a particular sequence identification number may also comprise the corresponding RNA (e.g., mRNA) sequence encoded by the DNA, where each "T" of the DNA sequence is substituted with "U."

The basic components of an mRNA molecule typically include at least one coding region, a 5' untranslated region (UTR), a 3' UTR, a 5' cap and a poly-A tail. Polynucleotides of the present disclosure may function as mRNA but can be distinguished from wild-type mRNA in their functional and/or structural design features, which serve to overcome existing problems of effective polypeptide expression using nucleic-acid based therapeutics.

In some embodiments, a RNA polynucleotide of an RNA (e.g., mRNA) vaccine encodes 2-10, 2-9, 2-8, 2-7, 2-6, 2-5, 2-4, 2-3, 3-10, 3-9, 3-8, 3-7, 3-6, 3-5, 3-4, 4-10, 4-9, 4-8, 4-7, 4-6, 4-5, 5-10, 5-9, 5-8, 5-7, 5-6, 6-10, 6-9, 6-8, 6-7, 7-10, 7-9, 7-8, 8-10, 8-9 or 9-10 antigenic polypeptides. In some embodiments, a RNA (e.g., mRNA) polynucleotide of a tropical disease vaccine encodes at least 10, 20, 30, 40, 50, 60, 70, 80, 90 or 100 antigenic polypeptides. In some embodiments, a RNA (e.g., mRNA) polynucleotide of a tropical disease vaccine encodes at least 100 or at least 200 antigenic polypeptides. In some embodiments, a RNA polynucleotide of a tropical disease vaccine encodes 1-10, 5-15, 10-20, 15-25, 20-30, 25-35, 30-40, 35-45, 40-50, 1-50, 1-100, 2-50 or 2-100 antigenic polypeptides.

Polynucleotides of the present disclosure, in some embodiments, are codon optimized. Codon optimization methods are known in the art and may be used as provided herein. Codon optimization, in some embodiments, may be used to match codon frequencies in target and host organisms to ensure proper folding; bias GC content to increase mRNA stability or reduce secondary structures; minimize tandem repeat codons or base runs that may impair gene construction or expression; customize transcriptional and translational control regions; insert or remove protein trafficking sequences; remove/add post translation modification sites in encoded protein (e.g. glycosylation sites); add, remove or shuffle protein domains; insert or delete restriction sites; modify ribosome binding sites and mRNA degradation sites; adjust translational rates to allow the various domains of the protein to fold properly; or to reduce or eliminate problem secondary structures within the polynucleotide. Codon optimization tools, algorithms and services are known in the art—non-limiting examples include services from GeneArt (Life Technologies), DNA2.0 (Menlo Park Calif.) and/or proprietary methods. In some embodiments, the open reading frame (ORF) sequence is optimized using optimization algorithms.

In some embodiments, a codon optimized sequence shares less than 95% sequence identity, less than 90% sequence identity, less than 85% sequence identity, less than 80% sequence identity, or less than 75% sequence identity to a naturally-occurring or wild-type sequence (e.g., a naturally-occurring or wild-type mRNA sequence encoding a polypeptide or protein of interest (e.g., an antigenic protein or antigenic polypeptide)).

In some embodiments, a codon-optimized sequence shares between 65% and 85% (e.g., between about 67% and about 85%, or between about 67% and about 80%) sequence identity to a naturally-occurring sequence or a wild-type sequence (e.g., a naturally-occurring or wild-type mRNA sequence encoding a polypeptide or protein of interest (e.g., an antigenic protein or polypeptide)). In some embodiments, a codon-optimized sequence shares between 65% and 75%, or about 80% sequence identity to a naturally-occurring sequence or wild-type sequence (e.g., a naturally-occurring or wild-type mRNA sequence encoding a polypeptide or protein of interest (e.g., an antigenic protein or polypeptide)).

In some embodiments a codon-optimized RNA (e.g., mRNA) may, for instance, be one in which the levels of G/C are enhanced. The G/C-content of nucleic acid molecules may influence the stability of the RNA. RNA having an increased amount of guanine (G) and/or cytosine (C) residues may be functionally more stable than nucleic acids containing a large amount of adenine (A) and thymine (T) or uracil (U) nucleotides. WO02/098443 discloses a pharmaceutical composition containing an mRNA stabilized by sequence modifications in the translated region. Due to the degeneracy of the genetic code, the modifications work by substituting existing codons for those that promote greater RNA stability without changing the resulting amino acid. The approach is limited to coding regions of the RNA.

Antigens/Antigenic Polypeptides

In some embodiments, an antigenic polypeptide (e.g., at least one Malaria (e.g., P. falciparum, P. vivax, P. malariae and/or P. ovale), JEV, WNV, EEEV, VEEV, SINV, CHIKV, DENV, ZIKV and/or YFV antigenic polypeptide) is longer than 25 amino acids and shorter than 50 amino acids. Polypeptides include gene products, naturally occurring polypeptides, synthetic polypeptides, homologs, orthologs, paralogs, fragments and other equivalents, variants, and analogs of the foregoing. A polypeptide may be a single molecule or may be a multi-molecular complex such as a dimer, trimer or tetramer. Polypeptides may also comprise single chain polypeptides or multichain polypeptides, such as antibodies or insulin, and may be associated or linked to each other. Most commonly, disulfide linkages are found in multichain polypeptides. The term "polypeptide" may also apply to amino acid polymers in which at least one amino acid residue is an artificial chemical analogue of a corresponding naturally-occurring amino acid.

A "polypeptide variant" is a molecule that differs in its amino acid sequence relative to a native sequence or a reference sequence Amino acid sequence variants may possess substitutions, deletions, insertions, or a combination of any two or three of the foregoing, at certain positions within the amino acid sequence, as compared to a native sequence or a reference sequence. Ordinarily, variants possess at least 50% identity to a native sequence or a reference sequence. In some embodiments, variants share at least 80% identity or at least 90% identity with a native sequence or a reference sequence.

In some embodiments "variant mimics" are provided. A "variant mimic" contains at least one amino acid that would mimic an activated sequence. For example, glutamate may serve as a mimic for phosphoro-threonine and/or phosphoro-serine. Alternatively, variant mimics may result in deactivation or in an inactivated product containing the mimic. For example, phenylalanine may act as an inactivating substitution for tyrosine, or alanine may act as an inactivating substitution for serine.

"Orthologs" refers to genes in different species that evolved from a common ancestral gene by speciation. Normally, orthologs retain the same function in the course of evolution. Identification of orthologs is important for reliable prediction of gene function in newly sequenced genomes.

"Analogs" is meant to include polypeptide variants that differ by one or more amino acid alterations, for example, substitutions, additions or deletions of amino acid residues that still maintain one or more of the properties of the parent or starting polypeptide.

The present disclosure provides several types of compositions that are polynucleotide or polypeptide based, including variants and derivatives. These include, for example, substitutional, insertional, deletion and covalent variants and derivatives. The term "derivative" is synonymous with the term "variant" and generally refers to a molecule that has been modified and/or changed in any way relative to a reference molecule or a starting molecule.

As such, polynucleotides encoding peptides or polypeptides containing substitutions, insertions and/or additions, deletions and covalent modifications with respect to reference sequences, in particular the polypeptide sequences disclosed herein, are included within the scope of this disclosure. For example, sequence tags or amino acids, such as one or more lysines, can be added to peptide sequences (e.g., at the N-terminal or C-terminal ends). Sequence tags can be used for peptide detection, purification or localization. Lysines can be used to increase peptide solubility or to allow for biotinylation. Alternatively, amino acid residues located at the carboxy and amino terminal regions of the amino acid sequence of a peptide or protein may optionally be deleted providing for truncated sequences. Certain amino acids (e.g., C-terminal residues or N-terminal residues) alternatively may be deleted depending on the use of the sequence, as for example, expression of the sequence as part of a larger sequence that is soluble, or linked to a solid support.

"Substitutional variants" when referring to polypeptides are those that have at least one amino acid residue in a native or starting sequence removed and a different amino acid inserted in its place at the same position. Substitutions may be single, where only one amino acid in the molecule has been substituted, or they may be multiple, where two or more (e.g., 3, 4 or 5) amino acids have been substituted in the same molecule.

As used herein the term "conservative amino acid substitution" refers to the substitution of an amino acid that is normally present in the sequence with a different amino acid of similar size, charge, or polarity. Examples of conservative substitutions include the substitution of a non-polar (hydrophobic) residue such as isoleucine, valine and leucine for another non-polar residue. Likewise, examples of conservative substitutions include the substitution of one polar (hydrophilic) residue for another such as between arginine and lysine, between glutamine and asparagine, and between glycine and serine. Additionally, the substitution of a basic residue such as lysine, arginine or histidine for another, or the substitution of one acidic residue such as aspartic acid or glutamic acid for another acidic residue are additional examples of conservative substitutions. Examples of non-conservative substitutions include the substitution of a non-polar (hydrophobic) amino acid residue such as isoleucine, valine, leucine, alanine, methionine for a polar (hydrophilic) residue such as cysteine, glutamine, glutamic acid or lysine and/or a polar residue for a non-polar residue.

"Features" when referring to polypeptide or polynucleotide are defined as distinct amino acid sequence-based or nucleotide-based components of a molecule respectively. Features of the polypeptides encoded by the polynucleotides include surface manifestations, local conformational shape, folds, loops, half-loops, domains, half-domains, sites, termini and any combination(s) thereof.

As used herein when referring to polypeptides the term "domain" refers to a motif of a polypeptide having one or more identifiable structural or functional characteristics or properties (e.g., binding capacity, serving as a site for protein-protein interactions).

As used herein when referring to polypeptides the terms "site" as it pertains to amino acid based embodiments is used synonymously with "amino acid residue" and "amino acid side chain." As used herein when referring to polynucleotides the terms "site" as it pertains to nucleotide based embodiments is used synonymously with "nucleotide." A site represents a position within a peptide or polypeptide or polynucleotide that may be modified, manipulated, altered, derivatized or varied within the polypeptide-based or polynucleotide-based molecules.

As used herein the terms "termini" or "terminus" when referring to polypeptides or polynucleotides refer to an extremity of a polypeptide or polynucleotide respectively. Such extremity is not limited only to the first or final site of the polypeptide or polynucleotide but may include additional amino acids or nucleotides in the terminal regions. Polypeptide-based molecules may be characterized as having both an N-terminus (terminated by an amino acid with a free amino group ($NH_2$)) and a C-terminus (terminated by an amino acid with a free carboxyl group (COOH)). Proteins are in some cases made up of multiple polypeptide chains brought together by disulfide bonds or by non-covalent forces (multimers, oligomers). These proteins have multiple N- and C-termini. Alternatively, the termini of the polypeptides may be modified such that they begin or end, as the case may be, with a non-polypeptide based moiety such as an organic conjugate.

As recognized by those skilled in the art, protein fragments, functional protein domains, and homologous proteins are also considered to be within the scope of polypeptides of interest. For example, provided herein is any protein fragment (meaning a polypeptide sequence at least one amino acid residue shorter than a reference polypeptide sequence but otherwise identical) of a reference protein having a length of 10, 20, 30, 40, 50, 60, 70, 80, 90, 100 or longer than 100 amino acids. In another example, any protein that includes a stretch of 20, 30, 40, 50, or 100 (contiguous) amino acids that are 40%, 50%, 60%, 70%, 80%, 90%, 95%, or 100% identical to any of the sequences described herein can be utilized in accordance with the disclosure. In some embodiments, a polypeptide includes 2, 3, 4, 5, 6, 7, 8, 9, 10, or more mutations as shown in any of the sequences provided herein or referenced herein. In another example, any protein that includes a stretch of 20, 30, 40, 50, or 100 amino acids that are greater than 80%, 90%, 95%, or 100% identical to any of the sequences described herein, wherein the protein has a stretch of 5, 10, 15, 20, 25, or 30 amino acids that are less than 80%, 75%, 70%, 65% to 60% identical to any of the sequences described herein can be utilized in accordance with the disclosure.

Polypeptide or polynucleotide molecules of the present disclosure may share a certain degree of sequence similarity or identity with the reference molecules (e.g., reference polypeptides or reference polynucleotides), for example, with art-described molecules (e.g., engineered or designed molecules or wild-type molecules). The term "identity," as known in the art, refers to a relationship between the sequences of two or more polypeptides or polynucleotides, as determined by comparing the sequences. In the art, identity also means the degree of sequence relatedness between two sequences as determined by the number of matches between strings of two or more amino acid residues or nucleic acid residues. Identity measures the percent of identical matches between the smaller of two or more sequences with gap alignments (if any) addressed by a particular mathematical model or computer program (e.g., "algorithms"). Identity of related peptides can be readily calculated by known methods. "% identity" as it applies to polypeptide or polynucleotide sequences is defined as the percentage of residues (amino acid residues or nucleic acid residues) in the candidate amino acid or nucleic acid sequence that are identical with the residues in the amino acid sequence or nucleic acid sequence of a second sequence after aligning the sequences and introducing gaps, if necessary, to achieve the maximum percent identity. Methods and computer programs for the alignment are well known in the art. Identity depends on a calculation of percent identity but may differ in value due to gaps and penalties introduced in the calculation. Generally, variants of a particular polynucleotide or polypeptide have at least 40%, 45%, 50%, 55%, 60%, 65%, 70%, 75%, 80%, 85%, 90%, 91%, 92%, 93%, 94%, 95%, 96%, 97%, 98%, 99% but less than 100% sequence identity to that particular reference polynucleotide or polypeptide as determined by sequence alignment programs and parameters described herein and known to those skilled in the art. Such tools for alignment include those of the BLAST suite (Stephen F. Altschul, et al. (1997). "Gapped BLAST and PSI-BLAST: a new generation of protein database search programs," *Nucleic Acids* Res. 25:3389-3402). Another popular local alignment technique is based on the Smith-Waterman algorithm (Smith, T. F. & Waterman, M. S. (1981) "Identification of common molecular subsequences." *J. Mol. Biol.* 147:195-197). A general global alignment technique based on dynamic programming is the Needleman-Wunsch algorithm (Needleman, S. B. & Wunsch, C. D. (1970) "A general method applicable to the search for similarities in the amino acid sequences of two proteins." *J. Mol. Biol.* 48:443-453). More recently, a Fast Optimal Global Sequence Alignment Algorithm (FOGSAA) was developed that purportedly produces global alignment of nucleotide and protein sequences faster than other optimal global alignment methods, including the Needleman-Wunsch algorithm. Other tools are described herein, specifically in the definition of "identity" below.

As used herein, the term "homology" refers to the overall relatedness between polymeric molecules, e.g. between nucleic acid molecules (e.g. DNA molecules and/or RNA molecules) and/or between polypeptide molecules. Polymeric molecules (e.g. nucleic acid molecules (e.g. DNA molecules and/or RNA molecules) and/or polypeptide molecules) that share a threshold level of similarity or identity determined by alignment of matching residues are termed homologous. Homology is a qualitative term that describes a relationship between molecules and can be based upon the quantitative similarity or identity. Similarity or identity is a quantitative term that defines the degree of sequence match between two compared sequences. In some embodiments, polymeric molecules are considered to be "homologous" to one another if their sequences are at least 25%, 30%, 35%, 40%, 45%, 50%, 55%, 60%, 65%, 70%, 75%, 80%, 85%, 90%, 95%, or 99% identical or similar. The term "homologous" necessarily refers to a comparison between at least two sequences (polynucleotide or polypeptide sequences). Two polynucleotide sequences are considered homologous if the polypeptides they encode are at least 50%, 60%, 70%, 80%, 90%, 95%, or even 99% for at least one stretch of at least 20 amino acids. In some embodiments, homologous polynucleotide sequences are characterized by the ability to encode a stretch of at least 4-5 uniquely specified amino acids. For polynucleotide sequences less than 60 nucleotides in length, homology is determined by the ability to encode a stretch of at least 4-5 uniquely specified amino acids. Two protein sequences are considered homologous if the proteins are at least 50%, 60%, 70%, 80%, or 90% identical for at least one stretch of at least 20 amino acids.

Homology implies that the compared sequences diverged in evolution from a common origin. The term "homolog" refers to a first amino acid sequence or nucleic acid sequence (e.g., gene (DNA or RNA) or protein sequence) that is related to a second amino acid sequence or nucleic acid sequence by descent from a common ancestral sequence. The term "homolog" may apply to the relationship between genes and/or proteins separated by the event of speciation or to the relationship between genes and/or proteins separated by the event of genetic duplication. "Orthologs" are genes (or proteins) in different species that evolved from a common ancestral gene (or protein) by speciation. Typically, orthologs retain the same function in the course of evolution. "Paralogs" are genes (or proteins) related by duplication within a genome. Orthologs retain the same function in the course of evolution, whereas paralogs evolve new functions, even if these are related to the original one.

The term "identity" refers to the overall relatedness between polymeric molecules, for example, between polynucleotide molecules (e.g. DNA molecules and/or RNA molecules) and/or between polypeptide molecules. Calculation of the percent identity of two polynucleic acid sequences, for example, can be performed by aligning the two sequences for optimal comparison purposes (e.g., gaps can be introduced in one or both of a first and a second nucleic acid sequences for optimal alignment and non-identical sequences can be disregarded for comparison purposes). In certain embodiments, the length of a sequence aligned for comparison purposes is at least 30%, at least 40%, at least 50%, at least 60%, at least 70%, at least 80%, at least 90%, at least 95%, or 100% of the length of the reference sequence. The nucleotides at corresponding nucleotide positions are then compared. When a position in the first sequence is occupied by the same nucleotide as the corresponding position in the second sequence, then the molecules are identical at that position. The percent identity between the two sequences is a function of the number of identical positions shared by the sequences, taking into account the number of gaps, and the length of each gap, which needs to be introduced for optimal alignment of the two sequences. The comparison of sequences and determination of percent identity between two sequences can be accomplished using a mathematical algorithm. For example, the percent identity between two nucleic acid sequences can be determined using methods such as those described in Computational Molecular Biology, Lesk, A. M., ed., Oxford University Press, New York, 1988; Biocomputing: Informatics and Genome Projects, Smith, D. W., ed., Academic Press, New York, 1993; Sequence Analysis in Molecular Biology, von Heinje, G., Academic Press, 1987; Computer Analysis of Sequence Data, Part I, Griffin, A. M., and Griffin, H. G., eds., Humana Press, New Jersey, 1994; and Sequence Analysis Primer, Gribskov, M. and Devereux, J., eds., M Stockton Press, New York, 1991; each of which is incorporated herein by reference. For example, the percent identity between two nucleic acid sequences can be determined using the algorithm of Meyers and Miller (CABIOS, 1989, 4:11-17), which has been incorporated into the ALIGN program (version 2.0) using a PAM120 weight residue table, a gap length penalty of 12 and a gap penalty of 4. The percent identity between two nucleic acid sequences can, alternatively, be determined using the GAP program in the GCG software package using an NWSgapdna.CMP matrix. Methods commonly employed to determine percent identity between sequences include, but are not limited to those disclosed in Carillo, H., and Lipman, D., SIAM *J Applied Math.*, 48:1073 (1988); incorporated herein by reference. Techniques for determining identity are codified in publicly available computer programs. Exemplary computer software to determine homology between two sequences include, but are not limited to, GCG program package, Devereux, J., et al., *Nucleic Acids Research,* 12, 387 (1984)), BLASTP, BLASTN, and FASTA Altschul, S. F. et al., *J. Molec. Biol.,* 215, 403 (1990)).

Multiprotein and Multicomponent Vaccines

The present disclosure encompasses tropical disease vaccines comprising multiple RNA (e.g., mRNA) polynucleotides, each encoding a single antigenic polypeptide, as well as tropical disease vaccines comprising a single RNA polynucleotide encoding more than one antigenic polypeptide (e.g., as a fusion polypeptide). Thus, a vaccine composition comprising a RNA (e.g., mRNA) polynucleotide having an open reading frame encoding a first antigenic polypeptide and a RNA (e.g., mRNA) polynucleotide having an open reading frame encoding a second antigenic polypeptide encompasses (a) vaccines that comprise a first RNA polynucleotide encoding a first antigenic polypeptide and a second RNA polynucleotide encoding a second antigenic polypeptide, and (b) vaccines that comprise a single RNA polynucleotide encoding a first and second antigenic polypeptide (e.g., as a fusion polypeptide). RNA (e.g., mRNA) vaccines of the present disclosure, in some embodiments, comprise 2-10 (e.g., 2, 3, 4, 5, 6, 7, 8, 9 or 10), or more, RNA polynucleotides having an open reading frame, each of which encodes a different antigenic polypeptide (or a single RNA polynucleotide encoding 2-10, or more, different antigenic polypeptides). The antigenic polypeptides may be selected from Malaria (e.g., *P. falciparum, P. vivax, P. malariae* and/or *P. ovale*), JEV, WNV, EEEV, VEEV, SINV, CHIKV, DENV, ZIKV and YFV antigenic polypeptides.

In some embodiments, a tropical disease vaccine comprises a RNA (e.g., mRNA) polynucleotide having an open reading frame encoding a viral capsid protein, a RNA (e.g., mRNA) polynucleotide having an open reading frame encoding a viral premembrane/membrane protein, and a RNA (e.g., mRNA) polynucleotide having an open reading frame encoding a viral envelope protein. In some embodiments, a tropical disease vaccine comprises a RNA (e.g., mRNA) polynucleotide having an open reading frame encoding a viral fusion (F) protein and a RNA polynucleotide having an open reading frame encoding a viral major surface glycoprotein (G protein). In some embodiments, a vaccine comprises a RNA (e.g., mRNA) polynucleotide having an open reading frame encoding a viral F protein. In some embodiments, a vaccine comprises a RNA (e.g., mRNA) polynucleotide having an open reading frame encoding a viral G protein. In some embodiments, a vaccine comprises a RNA (e.g., mRNA) polynucleotide having an open reading frame encoding a HN protein.

In some embodiments, a multicomponent vaccine comprises at least one RNA (e.g., mRNA) polynucleotide encoding at least one antigenic polypeptide fused to a signal peptide (e.g., SEQ ID NO: 304-307). The signal peptide may be fused at the N-terminus or the C-terminus of an antigenic polypeptide. An antigenic polypeptide fused to a signal peptide may be selected from Malaria (e.g., *P. falciparum, P. vivax, P. malariae* and/or *P. ovale*), JEV, WNV, EEEV, VEEV, SINV, CHIKV, DENV, ZIKV and YFV antigenic polypeptides.

Signal Peptides

In some embodiments, antigenic polypeptides encoded by tropical disease RNA (e.g., mRNA) polynucleotides comprise a signal peptide. Signal peptides, comprising the N-terminal 15-60 amino acids of proteins, are typically needed for the translocation across the membrane on the secretory pathway and, thus, universally control the entry of most proteins both in eukaryotes and prokaryotes to the secretory pathway. Signal peptides generally include three regions: an N-terminal region of differing length, which usually comprises positively charged amino acids; a hydrophobic region; and a short carboxy-terminal peptide region. In eukaryotes, the signal peptide of a nascent precursor protein (pre-protein) directs the ribosome to the rough endoplasmic reticulum (ER) membrane and initiates the transport of the growing peptide chain across it for processing. ER processing produces mature proteins, wherein the signal peptide is cleaved from precursor proteins, typically by a ER-resident signal peptidase of the host cell, or they remain uncleaved and function as a membrane anchor. A signal peptide may also facilitate the targeting of the protein to the cell membrane. The signal peptide, however, is not responsible for the final destination of the mature protein. Secretory proteins devoid of additional address tags in their sequence are by default secreted to the external environment. During recent years, a more advanced view of signal peptides has evolved, showing that the functions and immunodominance of certain signal peptides are much more versatile than previously anticipated.

Tropical disease vaccines of the present disclosure may comprise, for example, RNA (e.g., mRNA) polynucleotides encoding an artificial signal peptide, wherein the signal peptide coding sequence is operably linked to and is in frame with the coding sequence of the antigenic polypeptide. Thus, tropical disease vaccines of the present disclosure, in some embodiments, produce an antigenic polypeptide (e.g., a Malaria (e.g., *P. falciparum, P. vivax, P. malariae* and/or *P. ovale*), JEV, WNV, EEEV, VEEV, SINV, CHIKV, DENV, ZIKV and/or YFV antigenic polypeptide) fused to a signal peptide. In some embodiments, a signal peptide is fused to the N-terminus of the antigenic polypeptide. In some embodiments, a signal peptide is fused to the C-terminus of the antigenic polypeptide.

In some embodiments, the signal peptide fused to the antigenic polypeptide is an artificial signal peptide. In some embodiments, an artificial signal peptide fused to the antigenic polypeptide encoded by the RNA (e.g., mRNA) vaccine is obtained from an immunoglobulin protein, e.g., an IgE signal peptide or an IgG signal peptide. In some embodiments, a signal peptide fused to the antigenic polypeptide encoded by a RNA (e.g., mRNA) vaccine is an Ig heavy chain epsilon-1 signal peptide (IgE HC SP) having the sequence of: MDWTWILFLVAAATRVHS; SEQ ID NO: 424. In some embodiments, a signal peptide fused to the antigenic polypeptide encoded by the (e.g., mRNA) RNA (e.g., mRNA) vaccine is an IgGk chain V-III region HAH signal peptide (IgGk SP) having the sequence of MET-PAQLLFLLLLWLPDTTG; SEQ ID NO: 423. In some embodiments, the signal peptide is selected from: Japanese encephalitis PRM signal sequence (MLGSNSGQRV-VFTILLLLVAPAYS; SEQ ID NO: 425), VSINVg protein signal sequence (MKCLLYLAFLFIGVNCA; SEQ ID NO: 426) and Japanese encephalitis JEV signal sequence (MWLVSLAIVTACAGA; SEQ ID NO: 427).

In some embodiments, the antigenic polypeptide encoded by a RNA (e.g., mRNA) vaccine comprises an amino acid sequence identified by any one of SEQ ID NO: 13-17, 22-29, 44-47, 52-54, 59-64, 97-117, 156-222, 469, 259-291 or 402-413 fused to a signal peptide identified by any one of SEQ ID NO: 423-427. The examples disclosed herein are not meant to be limiting and any signal peptide that is known in the art to facilitate targeting of a protein to ER for processing and/or targeting of a protein to the cell membrane may be used in accordance with the present disclosure.

A signal peptide may have a length of 15-60 amino acids. For example, a signal peptide may have a length of 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, or 60 amino acids. In some embodiments, a signal peptide has a length of 20-60, 25-60, 30-60, 35-60, 40-60, 45-60, 50-60, 55-60, 15-55, 20-55, 25-55, 30-55, 35-55, 40-55, 45-55, 50-55, 15-50, 20-50, 25-50, 30-50, 35-50, 40-50, 45-50, 15-45, 20-45, 25-45, 30-45, 35-45, 40-45, 15-40, 20-40, 25-40, 30-40, 35-40, 15-35, 20-35, 25-35, 30-35, 15-30, 20-30, 25-30, 15-25, 20-25, or 15-20 amino acids.

A signal peptide is typically cleaved from the nascent polypeptide at the cleavage junction during ER processing. The mature antigenic polypeptide produce by a tropical disease RNA (e.g., mRNA) vaccine of the present disclosure typically does not comprise a signal peptide.

Chemical Modifications

Tropical disease vaccines of the present disclosure, in some embodiments, comprise at least RNA (e.g. mRNA) polynucleotide having an open reading frame encoding at least one antigenic polypeptide that comprises at least one chemical modification.

The terms "chemical modification" and "chemically modified" refer to modification with respect to adenosine (A), guanosine (G), uridine (U), thymidine (T) or cytidine (C) ribonucleosides or deoxyribnucleosides in at least one of their position, pattern, percent or population. Generally, these terms do not refer to the ribonucleotide modifications in naturally occurring 5'-terminal mRNA cap moieties. With respect to a polypeptide, the term "modification" refers to a modification relative to the canonical set 20 amino acids. Polypeptides, as provided herein, are also considered "modified" of they contain amino acid substitutions, insertions or a combination of substitutions and insertions.

Polynucleotides (e.g., RNA polynucleotides, such as mRNA polynucleotides), in some embodiments, comprise various (more than one) different modifications. In some embodiments, a particular region of a polynucleotide contains one, two or more (optionally different) nucleoside or nucleotide modifications. In some embodiments, a modified RNA polynucleotide (e.g., a modified mRNA polynucleotide), introduced to a cell or organism, exhibits reduced degradation in the cell or organism, respectively, relative to an unmodified polynucleotide. In some embodiments, a modified RNA polynucleotide (e.g., a modified mRNA polynucleotide), introduced into a cell or organism, may exhibit reduced immunogenicity in the cell or organism, respectively (e.g., a reduced innate response).

Modifications of polynucleotides include, without limitation, those described herein. Polynucleotides (e.g., RNA polynucleotides, such as mRNA polynucleotides) may comprise modifications that are naturally-occurring, non-naturally-occurring or the polynucleotide may comprise a combination of naturally-occurring and non-naturally-occurring modifications. Polynucleotides may include any useful modification, for example, of a sugar, a nucleobase, or an internucleoside linkage (e.g., to a linking phosphate, to a phosphodiester linkage or to the phosphodiester backbone).

Polynucleotides (e.g., RNA polynucleotides, such as mRNA polynucleotides), in some embodiments, comprise non-natural modified nucleotides that are introduced during synthesis or post-synthesis of the polynucleotides to achieve desired functions or properties. The modifications may be present on an internucleotide linkages, purine or pyrimidine bases, or sugars. The modification may be introduced with chemical synthesis or with a polymerase enzyme at the terminal of a chain or anywhere else in the chain. Any of the regions of a polynucleotide may be chemically modified.

The present disclosure provides for modified nucleosides and nucleotides of a polynucleotide (e.g., RNA polynucleotides, such as mRNA polynucleotides). A "nucleoside" refers to a compound containing a sugar molecule (e.g., a pentose or ribose) or a derivative thereof in combination with an organic base (e.g., a purine or pyrimidine) or a derivative thereof (also referred to herein as "nucleobase"). A "nucleotide" refers to a nucleoside, including a phosphate group. Modified nucleotides may by synthesized by any useful method, such as, for example, chemically, enzymatically, or recombinantly, to include one or more modified or non-natural nucleosides. Polynucleotides may comprise a region or regions of linked nucleosides. Such regions may have variable backbone linkages. The linkages may be standard phosphodiester linkages, in which case the polynucleotides would comprise regions of nucleotides.

Modified nucleotide base pairing encompasses not only the standard adenosine-thymine, adenosine-uracil, or guanosine-cytosine base pairs, but also base pairs formed between nucleotides and/or modified nucleotides comprising non-standard or modified bases, wherein the arrangement of hydrogen bond donors and hydrogen bond acceptors permits hydrogen bonding between a non-standard base and a standard base or between two complementary non-standard base structures. One example of such non-standard base pairing is the base pairing between the modified nucleotide inosine and adenine, cytosine or uracil. Any combination of base/sugar or linker may be incorporated into polynucleotides of the present disclosure.

Modifications of polynucleotides (e.g., RNA polynucleotides, such as mRNA polynucleotides) that are useful in the vaccines of the present disclosure include, but are not limited to the following: 2-methylthio-N6-(cis-hydroxyisopentenyl)adenosine; 2-methylthio-N6-methyladenosine; 2-methylthio-N6-threonyl carbamoyladenosine; N6-glycinylcarbamoyladenosine; N6-isopentenyladenosine; N6-methyladenosine; N6-threonylcarbamoyladenosine; 1,2'-O-dimethyladenosine; 1-methyladenosine; 2'-O-methyladenosine; 2'-O-ribosyladenosine (phosphate); 2-methyladenosine; 2-methylthio-N6 isopentenyladenosine; 2-methylthio-N6-hydroxynorvalyl carbamoyladenosine; 2'-O-methyladenosine; 2'-O-ribosyladenosine (phosphate); Isopentenyladenosine; N6-(cis-hydroxyisopentenyl)adenosine; N6,2'-O-dimethyladenosine; N6,2'-O-dimethyladenosine; N6,N6,2'-O-trimethyladenosine; N6,N6-dimethyladenosine; N6-acetyladenosine; N6-hydroxynorvalylcarbamoyladenosine; N6-methyl-N6-threonylcarbamoyladenosine; 2-methyladenosine; 2-methylthio-N6-isopentenyladenosine; 7-deaza-adenosine; N1-methyl-adenosine; N6, N6 (dimethyl)adenine; N6-cis-hydroxy-isopentenyl-adenosine; α-thio-adenosine; 2 (amino)adenine; 2 (aminopropyl)adenine; 2 (methylthio) N6 (isopentenyl)adenine; 2-(alkyl)adenine; 2-(aminoalkyl)adenine; 2-(aminopropyl) adenine; 2-(halo)adenine; 2-(halo)adenine; 2-(propyl)adenine; 2'-Amino-2'-deoxy-ATP; 2'-Azido-2'-deoxy-ATP; 2'-Deoxy-2'-a-aminoadenosine TP; 2'-Deoxy-2'-a-azidoadenosine TP; 6 (alkyl)adenine; 6 (methyl)adenine; 6-(alkyl) adenine; 6-(methyl)adenine; 7 (deaza)adenine; 8 (alkenyl) adenine; 8 (alkynyl)adenine; 8 (amino)adenine; 8 (thioalkyl) adenine; 8-(alkenyl)adenine; 8-(alkyl)adenine; 8-(alkynyl) adenine; 8-(amino)adenine; 8-(halo)adenine; 8-(hydroxyl) adenine; 8-(thioalkyl)adenine; 8-(thiol)adenine; 8-azidoadenosine; aza adenine; deaza adenine; N6 (methyl)adenine; N6-(isopentyl)adenine; 7-deaza-8-aza-adenosine; 7-methyladenine; 1-Deazaadenosine TP; 2'Fluoro-N6-Bz-deoxyadenosine TP; 2'-OMe-2-Amino-ATP; 2'O-methyl-N6-Bz-deoxyadenosine TP; 2'-a-Ethynyladenosine TP; 2-aminoadenine; 2-Aminoadenosine TP; 2-Amino-ATP; 2'-a-Trifluoromethyladenosine TP; 2-Azidoadenosine TP; 2'-b-Ethynyladenosine TP; 2-Bromoadenosine TP; 2'-b-Trifluoromethyladenosine TP; 2-Chloroadenosine TP; 2'-Deoxy-2',2'-difluoroadenosine TP; 2'-Deoxy-2'-a-mercaptoadenosine TP; 2'-Deoxy-2'-a-thiomethoxyadenosine TP; 2'-Deoxy-2'-b-aminoadenosine TP; 2'-Deoxy-2'-b-azidoadenosine TP; 2'-Deoxy-2'-b-bromoadenosine TP; 2'-Deoxy-2'-b-chloroadenosine TP; 2'-Deoxy-2'-b-fluoroadenosine TP; 2'-Deoxy-2'-b-iodoadenosine TP; 2'-Deoxy-2'-b-mercaptoadenosine TP; 2'-Deoxy-2'-b-thiomethoxyadenosine TP; 2-Fluoroadenosine TP; 2-Iodoadenosine TP; 2-Mercaptoadenosine TP; 2-methoxy-adenine; 2-methylthio-adenine; 2-Trifluoromethyladenosine TP; 3-Deaza-3-bromoadenosine TP; 3-Deaza-3-chloroadenosine TP; 3-Deaza-3-fluoroadenosine TP; 3-Deaza-3-iodoadenosine TP; 3-Deazaadenosine TP; 4'-Azidoadenosine TP; 4'-Carbocyclic adenosine TP; 4'-Ethynyladenosine TP; 5'-Homo-adenosine TP; 8-Aza-ATP; 8-bromo-adenosine TP; 8-Trifluoromethyladenosine TP; 9-Deazaadenosine TP; 2-aminopurine; 7-deaza-2,6-diaminopurine; 7-deaza-8-aza-2,6-diaminopurine; 7-deaza-8-aza-2-aminopurine; 2,6-diaminopurine; 7-deaza-8-aza-adenine, 7-deaza-2-aminopurine; 2-thiocytidine; 3-methylcytidine; 5-formylcytidine; 5-hydroxymethylcytidine; 5-methylcytidine; N4-acetylcytidine; 2'-O-methylcytidine; 2'-O-methylcytidine; 2'-methylcytidine; 5,2'-O-dimethylcytidine; 5-formyl-2'-O-methylcytidine; Lysidine; N4,2'-O-dimethylcytidine; N4-acetyl-2'-O-methylcytidine; N4-methylcytidine; N4,N4-Dimethyl-2'-OMe-Cytidine TP; 4-methylcytidine; 5-aza-cytidine; Pseudo-iso-cytidine; pyrrolo-cytidine; α-thio-cytidine; 2-(thio)cytosine; 2'-Amino-2'-deoxy-CTP; 2'-Azido-2'-deoxy-CTP; 2'-Deoxy-2'-a-aminocytidine TP; 2'-Deoxy-2'-a-azidocytidine TP; 3 (deaza) 5 (aza)cytosine; 3 (methyl)cytosine; 3-(alkyl)cytosine; 3-(deaza) 5 (aza)cytosine; 3-(methyl)cytidine; 4,2'-O-dimethylcytidine; 5 (halo) cytosine; 5 (methyl)cytosine; 5 (propynyl)cytosine; 5 (trifluoromethyl)cytosine; 5-(alkyl)cytosine; 5-(alkynyl) cytosine; 5-(halo)cytosine; 5-(propynyl)cytosine; 5-(trifluoromethyl)cytosine; 5-bromo-cytidine; 5-iodo-cytidine; 5-propynyl cytosine; 6-(azo)cytosine; 6-aza-cytidine; aza cytosine; deaza cytosine; N4 (acetyl)cytosine; 1-methyl-1-deaza-pseudoisocytidine; 1-methyl-pseudoisocytidine; 2-methoxy-5-methyl-cytidine; 2-methoxy-cytidine; 2-thio-5-methyl-cytidine; 4-methoxy-1-methyl-pseudoisocytidine; 4-methoxy-pseudoisocytidine; 4-thio-1-methyl-1-deaza-pseudoisocytidine; 4-thio-1-methyl-pseudoisocytidine; 4-thio-pseudoisocytidine; 5-aza-zebularine; 5-methyl-zebularine; pyrrolo-pseudoisocytidine; Zebularine; (E)-5-(2-Bromo-vinyl)cytidine TP; 2,2'-anhydro-cytidine TP hydrochloride; 2'Fluor-N4-Bz-cytidine TP; 2'Fluoro-N4-Acetyl-cytidine TP; 2'-O-Methyl-N4-Acetyl-cytidine TP; 2'O-methyl-N4-Bz-cytidine TP; 2'-a-Ethynylcytidine TP; 2'-a-Trifluoromethylcytidine TP; 2'-b-Ethynylcytidine TP; 2'-b-Trifluoromethylcytidine TP; 2'-Deoxy-2',2'-difluorocytidine TP; 2'-Deoxy-2'-a-mercaptocytidine TP; 2'-Deoxy-2'-a-thiomethoxycytidine TP; 2'-Deoxy-2'-b-aminocytidine TP; 2'-Deoxy-2'-b-azidocytidine TP; 2'-Deoxy-2'-b-bromocytidine TP; 2'-Deoxy-2'-b-chlorocytidine TP; 2'-Deoxy-2'-b-fluorocytidine TP; 2'-Deoxy-2'-b-iodocytidine TP; 2'-Deoxy-2'-b-mercaptocytidine TP; 2'-Deoxy-2'-b-thiomethoxycytidine TP; 2'-O-Methyl-5-(1-propynyl) cytidine TP; 3'-Ethynylcytidine TP; 4'-Azidocytidine TP; 4'-Carbocyclic cytidine TP; 4'-Ethynylcytidine TP; 5-(1-Propynyl)ara-cytidine TP; 5-(2-Chloro-phenyl)-2-thiocytidine TP; 5-(4-Amino-phenyl)-2-thiocytidine TP; 5-Aminoallyl-CTP; 5-Cyanocytidine TP; 5-Ethynylara-cytidine TP; 5-Ethynylcytidine TP; 5'-Homo-cytidine TP; 5-Methoxycytidine TP; 5-Trifluoromethyl-Cytidine TP; N4-Amino-cytidine TP; N4-Benzoyl-cytidine TP; Pseudoisocytidine; 7-methylguanosine; N2,2'-O-dimethylguanosine; N2-methylguanosine; Wyosine; 1,2'-O-dimethylguanosine; 1-methylguanosine; 2'-O-methylguanosine; 2'-O-ribosylguanosine (phosphate); 2'-O-methylguanosine; 2'-O-ribosylguanosine (phosphate); 7-aminomethyl-7-deazaguanosine; 7-cyano-7-deazaguanosine; Archaeosine; Methylwyosine; N2,7-dimethylguanosine; N2,N2,2'-O-trimethylguanosine; N2,N2,7-trimethylguanosine; N2,N2-dimethylguanosine; N2,7,2'-O-trimethylguanosine; 6-thio-guanosine; 7-deaza-guanosine; 8-oxo-guanosine; N1-methyl-guanosine; α-thio-guanosine; 2 (propyl)guanine; 2-(alkyl)guanine; 2'-Amino-2'-deoxy-GTP; 2'-Azido-2'-deoxy-GTP; 2'-Deoxy-2'-a-aminoguanosine TP; 2'-Deoxy-2'-a-azidoguanosine TP; 6 (methyl)guanine; 6-(alkyl)guanine; 6-(methyl)guanine; 6-methylguanosine; 7 (alkyl)guanine; 7 (deaza)guanine; 7 (methyl) guanine; 7-(alkyl)guanine; 7-(deaza)guanine; 7-(methyl) guanine; 8 (alkyl)guanine; 8 (alkynyl)guanine; 8 (halo) guanine; 8 (thioalkyl)guanine; 8-(alkenyl)guanine; 8-(alkyl) guanine; 8-(alkynyl)guanine; 8-(amino)guanine; 8-(halo) guanine; 8-(hydroxyl)guanine; 8-(thioalkyl)guanine; 8-(thiol)guanine; aza guanine; deaza guanine; N (methyl) guanine; N-(methyl)guanine; 1-methyl-6-thio-guanosine; 6-methoxy-guanosine; 6-thio-7-deaza-8-aza-guanosine; 6-thio-7-deaza-guanosine; 6-thio-7-methyl-guanosine; 7-deaza-8-aza-guanosine; 7-methyl-8-oxo-guanosine; N2,N2-dimethyl-6-thio-guanosine; N2-methyl-6-thio-guanosine; 1-Me-GTP; 2'Fluoro-N2-isobutyl-guanosine TP; 2'O-methyl-N2-isobutyl-guanosine TP; 2'-a-Ethynylguanosine TP; 2'-a-Trifluoromethylguanosine TP; 2'-b-Ethynylguanosine TP; 2'-b-Trifluoromethylguanosine TP; 2'-Deoxy-2',2'-difluoroguanosine TP; 2'-Deoxy-2'-a-mercaptoguanosine TP; 2'-Deoxy-2'-a-thiomethoxyguanosine TP; 2'-Deoxy-2'-b-aminoguanosine TP; 2'-Deoxy-2'-b-azidoguanosine TP; 2'-Deoxy-2'-b-bromoguanosine TP; 2'-Deoxy-2'-b-chloroguanosine TP; 2'-Deoxy-2'-b-fluoroguanosine TP; 2'-Deoxy-2'-b-iodoguanosine TP; 2'-Deoxy-2'-b-mercaptoguanosine TP; 2'-Deoxy-2'-b-thiomethoxyguanosine TP; 4'-Azidoguanosine TP; 4'-Carbocyclic guanosine TP; 4'-Ethynylguanosine TP; 5'-Homo-guanosine TP; 8-bromo-guanosine TP; 9-Deazaguanosine TP; N2-isobutyl-guanosine TP; 1-methylinosine; Inosine; 1,2'-O-dimethylinosine; 2'-O-methylinosine; 7-methylinosine; 2'-O-methylinosine; Epoxyqueuosine; galactosyl-queuosine; Mannosylqueuosine; Queuosine; allyamino-thymidine; aza thymidine; deaza thymidine; deoxy-thymidine; 2'-O-methyluridine; 2-thiouridine; 3-methyluridine; 5-carboxymethyluridine; 5-hydroxyuridine; 5-methyluridine; 5-taurinomethyl-2-thiouridine; 5-taurinomethyluridine;

Dihydrouridine; Pseudouridine; (3-(3-amino-3-carboxypropyl)uridine; 1-methyl-3-(3-amino-5-carboxypropyl)pseudouridine; 1-methylpseduouridine; 1-methyl-pseudouridine; 2'-O-methyluridine; 2'-O-methylpseudouridine; 2'-O-methyluridine; 2-thio-2'-O-methyluridine; 3-(3-amino-3-carboxypropyl)uridine; 3,2'-O-dimethyluridine; 3-Methyl-pseudo-Uridine TP; 4-thiouridine; 5-(carboxyhydroxymethyl)uridine; 5-(carboxyhydroxymethyl)uridine methyl ester; 5,2'-O-dimethyluridine; 5,6-dihydro-uridine; 5-aminomethyl-2-thiouridine; 5-carbamoylmethyl-2'-O-methyluridine; 5-carbamoylmethyluridine; 5-carboxyhydroxymethyluridine; 5-carboxyhydroxymethyluridine methyl ester; 5-carboxymethylaminomethyl-2'-O-methyluridine; 5-carboxymethylaminomethyl-2-thiouridine; 5-carboxymethylaminomethyl-2-thiouridine; 5-carboxymethylaminomethyluridine; 5-carboxymethylaminomethyluridine; 5-Carbamoylmethyluridine TP; 5-methoxycarbonylmethyl-2'-O-methyluridine; 5-methoxycarbonylmethyl-2-thiouridine; 5-methoxycarbonylmethyluridine; 5-methoxyuridine; 5-methyl-2-thiouridine; 5-methylaminomethyl-2-selenouridine; 5-methylaminomethyl-2-thiouridine; 5-methylaminomethyluridine; 5-Methyldihydrouridine; 5-Oxyacetic acid-Uridine TP; 5-Oxyacetic acid-methyl ester-Uridine TP; N1-methyl-pseudo-uridine; uridine 5-oxyacetic acid; uridine 5-oxyacetic acid methyl ester; 3-(3-Amino-3-carboxypropyl)-Uridine TP; 5-(iso-Pentenylaminomethyl)-2-thiouridine TP; 5-(iso-Pentenylaminomethyl)-2'-O-methyluridine TP; 5-(iso-Pentenylaminomethyl)uridine TP; 5-propynyl uracil; α-thio-uridine; 1 (aminoalkylamino-carbonylethylenyl)-2(thio)-pseudouracil; 1 (aminoalkylaminocarbonylethylenyl)-2,4-(dithio)pseudouracil; 1 (aminoalkylaminocarbonylethylenyl)-4 (thio)pseudouracil; 1 (aminoalkylaminocarbonylethylenyl)-pseudouracil; 1 (aminocarbonylethylenyl)-2(thio)-pseudouracil; 1 (aminocarbonylethylenyl)-2,4-(dithio)pseudouracil; 1 (aminocarbonylethylenyl)-4 (thio)pseudouracil; 1 (aminocarbonylethylenyl)-pseudouracil; 1 substituted 2(thio)-pseudouracil; 1 substituted 2,4-(dithio)pseudouracil; 1 substituted 4 (thio) pseudouracil; 1 substituted pseudouracil; 1-(aminoalkylamino-carbonylethylenyl)-2-(thio)-pseudouracil; 1-Methyl-3-(3-amino-3-carboxypropyl) pseudouridine TP; 1-Methyl-3-(3-amino-3-carboxypropyl)pseudo-UTP; 1-Methyl-pseudo-UTP; 2 (thio)pseudouracil; 2' deoxy uridine; 2' fluorouridine; 2-(thio)uracil; 2,4-(dithio)psuedouracil; 2' methyl, 2'amino, 2'azido, 2'fluro-guanosine; 2'-Amino-2'-deoxy-UTP; 2'-Azido-2'-deoxy-UTP; 2'-Azido-deoxyuridine TP; 2'-O-methylpseudouridine; 2' deoxy uridine; 2' fluorouridine; 2'-Deoxy-2'-a-aminouridine TP; 2'-Deoxy-2'-a-azidouridine TP; 2-methylpseudouridine; 3 (3 amino-3 carboxypropyl)uracil; 4 (thio)pseudouracil; 4-(thio)pseudouracil; 4-(thio)uracil; 4-thiouracil; 5 (1,3-diazole-1-alkyl)uracil; 5 (2-aminopropyl)uracil; 5 (aminoalkyl)uracil; 5 (dimethylaminoalkyl)uracil; 5 (guanidiniumalkyl)uracil; 5 (methoxycarbonylmethyl)-2-(thio)uracil; 5 (methoxycarbonyl-methyl)uracil; 5 (methyl) 2 (thio)uracil; 5 (methyl) 2,4 (dithio)uracil; 5 (methyl) 4 (thio)uracil; 5 (methylaminomethyl)-2 (thio)uracil; 5 (methylaminomethyl)-2,4 (dithio)uracil; 5 (methylaminomethyl)-4 (thio) uracil; 5 (propynyl)uracil; 5 (trifluoromethyl)uracil; 5-(2-aminopropyl)uracil; 5-(alkyl)-2-(thio)pseudouracil; 5-(alkyl)-2,4 (dithio)pseudouracil; 5-(alkyl)-4 (thio) pseudouracil; 5-(alkyl)pseudouracil; 5-(alkyl)uracil; 5-(alkynyl)uracil; 5-(allylamino)uracil; 5-(cyanoalkyl)uracil; 5-(dialkylaminoalkyl)uracil; 5-(dimethylaminoalkyl) uracil; 5-(guanidiniumalkyl)uracil; 5-(halo)uracil; 5-(1,3-diazole-1-alkyl)uracil; 5-(methoxy)uracil; 5-(methoxycarbonylmethyl)-2-(thio)uracil; 5-(methoxycarbonyl-methyl)uracil; 5-(methyl) 2(thio)uracil; 5-(methyl) 2,4 (dithio)uracil; 5-(methyl) 4 (thio)uracil; 5-(methyl)-2-(thio)pseudouracil; 5-(methyl)-2,4 (dithio)pseudouracil; 5-(methyl)-4 (thio)pseudouracil; 5-(methyl)pseudouracil; 5-(methylaminomethyl)-2 (thio)uracil; 5-(methylaminomethyl)-2,4(dithio)uracil; 5-(methylaminomethyl)-4-(thio) uracil; 5-(propynyl)uracil; 5-(trifluoromethyl)uracil; 5-aminoallyl-uridine; 5-bromo-uridine; 5-iodo-uridine; 5-uracil; 6 (azo)uracil; 6-(azo)uracil; 6-aza-uridine; ally-amino-uracil; aza uracil; deaza uracil; N3 (methyl)uracil; Pseudo-UTP-1-2-ethanoic acid; Pseudouracil; 4-Thio-pseudo-UTP; 1-carboxymethyl-pseudouridine; 1-methyl-1-deaza-pseudouridine; 1-propynyl-uridine; 1-taurinomethyl-1-methyl-uridine; 1-taurinomethyl-4-thio-uridine; 1-taurinomethyl-pseudouridine; 2-methoxy-4-thio-pseudouridine; 2-thio-1-methyl-1-deaza-pseudouridine; 2-thio-1-methyl-pseudouridine; 2-thio-5-aza-uridine; 2-thio-dihydropseudouridine; 2-thio-dihydrouridine; 2-thio-pseudouridine; 4-methoxy-2-thio-pseudouridine; 4-methoxy-pseudouridine; 4-thio-1-methyl-pseudouridine; 4-thio-pseudouridine; 5-aza-uridine; Dihydropseudouridine; (±)1-(2-Hydroxypropyl)pseudouridine TP; (2R)-1-(2-Hydroxypropyl)pseudouridine TP; (2S)-1-(2-Hydroxypropyl)pseudouridine TP; (E)-5-(2-Bromo-vinyl)ara-uridine TP; (E)-5-(2-Bromo-vinyl)uridine TP; (Z)-5-(2-Bromo-vinyl) ara-uridine TP; (Z)-5-(2-Bromo-vinyl)uridine TP; 1-(2,2,2-Trifluoroethyl)-pseudo-UTP; 1-(2,2,3,3,3-Pentafluoropropyl)pseudouridine TP; 1-(2,2-Diethoxyethyl)pseudouridine TP; 1-(2,4,6-Trimethylbenzyl)pseudouridine TP; 1-(2,4,6-Trimethyl-benzyl)pseudo-UTP; 1-(2,4,6-Trimethyl-phenyl)pseudo-UTP; 1-(2-Amino-2-carboxyethyl)pseudo-UTP; 1-(2-Amino-ethyl)pseudo-UTP; 1-(2-Hydroxyethyl)pseudouridine TP; 1-(2-Methoxyethyl)pseudouridine TP; 1-(3,4-Bis-trifluoromethoxybenzyl)pseudouridine TP; 1-(3,4-Dimethoxybenzyl)pseudouridine TP; 1-(3-Amino-3-carboxypropyl)pseudo-UTP; 1-(3-Amino-propyl)pseudo-UTP; 1-(3-Cyclopropyl-prop-2-ynyl)pseudouridine TP; 1-(4-Amino-4-carboxybutyl)pseudo-UTP; 1-(4-Amino-benzyl)pseudo-UTP; 1-(4-Amino-butyl)pseudo-UTP; 1-(4-Amino-phenyl)pseudo-UTP; 1-(4-Azidobenzyl)pseudouridine TP; 1-(4-Bromobenzyl)pseudouridine TP; 1-(4-Chlorobenzyl)pseudouridine TP; 1-(4-Fluorobenzyl)pseudouridine TP; 1-(4-Iodobenzyl)pseudouridine TP; 1-(4-Methanesulfonylbenzyl)pseudouridine TP; 1-(4-Methoxybenzyl)pseudouridine TP; 1-(4-Methoxy-benzyl)pseudo-UTP; 1-(4-Methoxy-phenyl)pseudo-UTP; 1-(4-Methylbenzyl)pseudouridine TP; 1-(4-Methyl-benzyl)pseudo-UTP; 1-(4-Nitrobenzyl)pseudouridine TP; 1-(4-Nitro-benzyl)pseudo-UTP; 1(4-Nitro-phenyl)pseudo-UTP; 1-(4-Thiomethoxybenzyl)pseudouridine TP; 1-(4-Trifluoromethoxybenzyl)pseudouridine TP; 1-(4-Trifluoromethylbenzyl)pseudouridine TP; 1-(5-Amino-pentyl)pseudo-UTP; 1-(6-Amino-hexyl)pseudo-UTP; 1,6-Dimethyl-pseudo-UTP; 1-[3-(2-{2-[2-(2-Aminoethoxy)-ethoxy]-ethoxy}-ethoxy)-propionyl]pseudouridine TP; 1-{3-[2-(2-Aminoethoxy)-ethoxy]-propionyl}pseudouridine TP; 1-Acetylpseudouridine TP; 1-Alkyl-6-(1-propynyl)-pseudo-UTP; 1-Alkyl-6-(2-propynyl)-pseudo-UTP; 1-Alkyl-6-allyl-pseudo-UTP; 1-Alkyl-6-ethynyl-pseudo-UTP; 1-Alkyl-6-homoallyl-pseudo-UTP; 1-Alkyl-6-vinyl-pseudo-UTP; 1-Allylpseudouridine TP; 1-Aminomethyl-pseudo-UTP; 1-Benzoylpseudouridine TP; 1-Benzyloxymethylpseudouridine TP; 1-Benzyl-pseudo-UTP; 1-Biotinyl-PEG2-pseudouridine TP; 1-Biotinylpseudouridine TP; 1-Butyl-pseudo-UTP; 1-Cyanomethylpseudouridine TP; 1-Cyclobutylmethyl-pseudo-UTP; 1-Cyclobutyl-pseudo-UTP; 1-Cycloheptylmethyl-pseudo-UTP; 1-Cycloheptyl-pseudo-UTP;

1-Cyclohexylmethyl-pseudo-UTP; 1-Cyclohexyl-pseudo-UTP; 1-Cyclooctylmethyl-pseudo-UTP; 1-Cyclooctyl-pseudo-UTP; 1-Cyclopentylmethyl-pseudo-UTP; 1-Cyclopentyl-pseudo-UTP; 1-Cyclopropylmethyl-pseudo-UTP; 1-Cyclopropyl-pseudo-UTP; 1-Ethyl-pseudo-UTP; 1-Hexyl-pseudo-UTP; 1-Homoallylpseudouridine TP; 1-Hydroxymethylpseudouridine TP; 1-iso-propyl-pseudo-UTP; 1-Me-2-thio-pseudo-UTP; 1-Me-4-thio-pseudo-UTP; 1-Me-alpha-thio-pseudo-UTP; 1-Methanesulfonylmethylpseudouridine TP; 1-Methoxymethylpseudouridine TP; 1-Methyl-6-(2,2,2-Trifluoroethyl)pseudo-UTP; 1-Methyl-6-(4-morpholino)-pseudo-UTP; 1-Methyl-6-(4-thiomorpholino)-pseudo-UTP; 1-Methyl-6-(substituted phenyl)pseudo-UTP; 1-Methyl-6-amino-pseudo-UTP; 1-Methyl-6-azido-pseudo-UTP; 1-Methyl-6-bromo-pseudo-UTP; 1-Methyl-6-butyl-pseudo-UTP; 1-Methyl-6-chloro-pseudo-UTP; 1-Methyl-6-cyano-pseudo-UTP; 1-Methyl-6-dimethylamino-pseudo-UTP; 1-Methyl-6-ethoxy-pseudo-UTP; 1-Methyl-6-ethylcarboxylate-pseudo-UTP; 1-Methyl-6-ethyl-pseudo-UTP; 1-Methyl-6-fluoro-pseudo-UTP; 1-Methyl-6-formyl-pseudo-UTP; 1-Methyl-6-hydroxyamino-pseudo-UTP; 1-Methyl-6-hydroxy-pseudo-UTP; 1-Methyl-6-iodo-pseudo-UTP; 1-Methyl-6-iso-propyl-pseudo-UTP; 1-Methyl-6-methoxy-pseudo-UTP; 1-Methyl-6-methylamino-pseudo-UTP; 1-Methyl-6-phenyl-pseudo-UTP; 1-Methyl-6-propyl-pseudo-UTP; 1-Methyl-6-tert-butyl-pseudo-UTP; 1-Methyl-6-trifluoromethoxy-pseudo-UTP; 1-Methyl-6-trifluoromethyl-pseudo-UTP; 1-Morpholinomethylpseudouridine TP; 1-Pentyl-pseudo-UTP; 1-Phenyl-pseudo-UTP; 1-Pivaloylpseudouridine TP; 1-Propargylpseudouridine TP; 1-Propyl-pseudo-UTP; 1-propynyl-pseudouridine; 1-p-tolyl-pseudo-UTP; 1-tert-Butyl-pseudo-UTP; 1-Thiomethoxymethylpseudouridine TP; 1-Thiomorpholinomethylpseudouridine TP; 1-Trifluoroacetylpseudouridine TP; 1-Trifluoromethyl-pseudo-UTP; 1-Vinylpseudouridine TP; 2,2'-anhydro-uridine TP; 2'-bromo-deoxyuridine TP; 2'-F-5-Methyl-2'-deoxy-UTP; 2'-OMe-5-Me-UTP; 2'-OMe-pseudo-UTP; 2'-a-Ethynyluridine TP; 2'-a-Trifluoromethyluridine TP; 2'-b-Ethynyluridine TP; 2'-b-Trifluoromethyluridine TP; 2'-Deoxy-2',2'-difluorouridine TP; 2'-Deoxy-2'-a-mercaptouridine TP; 2'-Deoxy-2'-a-thiomethoxyuridine TP; 2'-Deoxy-2'-b-aminouridine TP; 2'-Deoxy-2'-b-azidouridine TP; 2'-Deoxy-2'-b-bromouridine TP; 2'-Deoxy-2'-b-chlorouridine TP; 2'-Deoxy-2'-b-fluorouridine TP; 2'-Deoxy-2'-b-iodouridine TP; 2'-Deoxy-2'-b-mercaptouridine TP; 2'-Deoxy-2'-b-thiomethoxyuridine TP; 2-methoxy-4-thio-uridine; 2-methoxyuridine; 2'-O-Methyl-5-(1-propynyl)uridine TP; 3-Alkyl-pseudo-UTP; 4'-Azidouridine TP; 4'-Carbocyclic uridine TP; 4'-Ethynyluridine TP; 5-(1-Propynyl)ara-uridine TP; 5-(2-Furanyl)uridine TP; 5-Cyanouridine TP; 5-Dimethylaminouridine TP; 5'-Homo-uridine TP; 5-iodo-2'-fluoro-deoxyuridine TP; 5-Phenylethynyluridine TP; 5-Trideuteromethyl-6-deuterouridine TP; 5-Trifluoromethyl-Uridine TP; 5-Vinylarauridine TP; 6-(2,2,2-Trifluoroethyl)-pseudo-UTP; 6-(4-Morpholino)-pseudo-UTP; 6-(4-Thiomorpholino)-pseudo-UTP; 6-(Substituted-Phenyl)-pseudo-UTP; 6-Amino-pseudo-UTP; 6-Azido-pseudo-UTP; 6-Bromo-pseudo-UTP; 6-Butyl-pseudo-UTP; 6-Chloro-pseudo-UTP; 6-Cyano-pseudo-UTP; 6-Dimethylamino-pseudo-UTP; 6-Ethoxy-pseudo-UTP; 6-Ethylcarboxylate-pseudo-UTP; 6-Ethyl-pseudo-UTP; 6-Fluoro-pseudo-UTP; 6-Formyl-pseudo-UTP; 6-Hydroxyamino-pseudo-UTP; 6-Hydroxy-pseudo-UTP; 6-Iodo-pseudo-UTP; 6-iso-Propyl-pseudo-UTP; 6-Methoxy-pseudo-UTP; 6-Methylamino-pseudo-UTP; 6-Methyl-pseudo-UTP; 6-Phenyl-pseudo-UTP; 6-Phenyl-pseudo-UTP; 6-Propyl-pseudo-UTP; 6-tert-Butyl-pseudo-UTP; 6-Trifluoromethoxy-pseudo-UTP; 6-Trifluoromethyl-pseudo-UTP; Alpha-thio-pseudo-UTP; Pseudouridine 1-(4-methylbenzenesulfonic acid) TP; Pseudouridine 1-(4-methylbenzoic acid) TP; Pseudouridine TP 1-[3-(2-ethoxy)]propionic acid; Pseudouridine TP 1-[3-{2-(2-[2-(2-ethoxy)-ethoxy]-ethoxy)-ethoxy}]propionic acid; Pseudouridine TP 1-[3-{2-(2-[2-{2(2-ethoxy)-ethoxy}-ethoxy]-ethoxy)-ethoxy}]propionic acid; Pseudouridine TP 1-[3-{2-(2-[2-ethoxy]-ethoxy)-ethoxy}]propionic acid; Pseudouridine TP 1-[3-{2-(2-ethoxy)-ethoxy}] propionic acid; Pseudouridine TP 1-methylphosphonic acid; Pseudouridine TP 1-methylphosphonic acid diethyl ester; Pseudo-UTP-N1-3-propionic acid; Pseudo-UTP-N1-4-butanoic acid; Pseudo-UTP-N1-5-pentanoic acid; Pseudo-UTP-N1-6-hexanoic acid; Pseudo-UTP-N1-7-heptanoic acid; Pseudo-UTP-N1-methyl-p-benzoic acid; Pseudo-UTP-N1-p-benzoic acid; Wybutosine; Hydroxywybutosine; Isowyosine; Peroxywybutosine; undermodified hydroxywybutosine; 4-demethylwyosine; 2,6-(diamino)purine; 1-(aza)-2-(thio)-3-(aza)-phenoxazin-1-yl; 1,3-(diaza)-2-(oxo)-phenthiazin-1-yl; 1,3-(diaza)-2-(oxo)-phenoxazin-1-yl; 1,3,5-(triaza)-2,6-(dioxa)-naphthalene; 2 (amino)purine; 2,4,5-(trimethyl)phenyl; 2' methyl, 2'amino, 2'azido, 2'fluro-cytidine; 2' methyl, 2'amino, 2'azido, 2'fluro-adenine; 2'methyl, 2'amino, 2'azido, 2'fluro-uridine; 2'-amino-2'-deoxyribose; 2-amino-6-Chloro-purine; 2-aza-inosinyl; 2'-azido-2'-deoxyribose; 2'fluoro-2'-deoxyribose; 2'-fluoro-modified bases; 2'-O-methyl-ribose; 2-oxo-7-aminopyridopyrimidin-3-yl; 2-oxo-pyridopyrimidine-3-yl; 2-pyridinone; 3 nitropyrrole; 3-(methyl)-7-(propynyl)isocarbostyrilyl; 3-(methyl)isocarbostyrilyl; 4-(fluoro)-6-(methyl)benzimidazole; 4-(methyl)benzimidazole; 4-(methyl)indolyl; 4,6-(dimethyl)indolyl; 5 nitroindole; 5 substituted pyrimidines; 5-(methyl)isocarbostyrilyl; 5-nitroindole; 6-(aza)pyrimidine; 6-(azo)thymine; 6-(methyl)-7-(aza)indolyl; 6-chloro-purine; 6-phenyl-pyrrolo-pyrimidin-2-on-3-yl; 7-(aminoalkylhydroxy)-1-(aza)-2-(thio)-3-(aza)-phenthiazin-1-yl; 7-(aminoalkylhydroxy)-1-(aza)-2-(thio)-3-(aza)-phenoxazin-1-yl; 7-(aminoalkylhydroxy)-1,3-(diaza)-2-(oxo)-phenoxazin-1-yl; 7-(aminoalkylhydroxy)-1,3-(diaza)-2-(oxo)-phenthiazin-1-yl; 7-(aminoalkylhydroxy)-1,3-(diaza)-2-(oxo)-phenoxazin-1-yl; 7-(aza)indolyl; 7-(guanidiniumalkylhydroxy)-1-(aza)-2-(thio)-3-(aza)-phenoxazinl-yl; 7-(guanidiniumalkylhydroxy)-1-(aza)-2-(thio)-3-(aza)-phenthiazin-1-yl; 7-(guanidiniumalkylhydroxy)-1-(aza)-2-(thio)-3-(aza)-phenoxazin-1-yl; 7-(guanidiniumalkylhydroxy)-1,3-(diaza)-2-(oxo)-phenoxazin-1-yl; 7-(guanidiniumalkylhydroxy)-1,3-(diaza)-2-(oxo)-phenthiazin-1-yl; 7-(guanidiniumalkylhydroxy)-1,3-(diaza)-2-(oxo)-phenoxazin-1-yl; 7-(propynyl)isocarbostyrilyl; 7-(propynyl)isocarbostyrilyl, propynyl-7-(aza)indolyl; 7-deaza-inosinyl; 7-substituted 1-(aza)-2-(thio)-3-(aza)-phenoxazin-1-yl; 7-substituted 1,3-(diaza)-2-(oxo)-phenoxazin-1-yl; 9-(methyl)-imidizopyridinyl; Aminoindolyl; Anthracenyl; bis-ortho-(aminoalkylhydroxy)-6-phenyl-pyrrolo-pyrimidin-2-on-3-yl; bis-ortho-substituted-6-phenyl-pyrrolo-pyrimidin-2-on-3-yl; Difluorotolyl; Hypoxanthine; Imidizopyridinyl; Inosinyl; Isocarbostyrilyl; Isoguanisine; N2-substituted purines; N6-methyl-2-amino-purine; N6-substituted purines; N-alkylated derivative; Napthalenyl; Nitrobenzimidazolyl; Nitroimidazolyl; Nitroindazolyl; Nitropyrazolyl; Nubularine; O6-substituted purines; O-alkylated derivative; ortho-(aminoalkylhydroxy)-6-phenyl-pyrrolo-pyrimidin-2-on-3-yl; ortho-substituted-6-phenyl-pyrrolo-pyrimidin-2-on-3-yl; Oxoformycin TP; para-(aminoalkylhydroxy)-6-phenyl-pyrrolo-pyrimidin-2-on-3- yl; para-substituted-6-phenyl-pyrrolo-pyrimidin-2-on-3-yl; Pentacenyl; Phenanthracenyl; Phenyl; propynyl-7-(aza)indolyl; Pyrenyl; pyridopyrimidin-3-yl; pyridopyrimidin-3-yl, 2-oxo-7-aminopyridopyrimidin-3-yl; pyrrolo-pyrimidin-2-on-3-yl; Pyrrolopyrimidinyl; Pyrrolopyrizinyl; Stilbenzyl; substituted 1,2,4-triazoles; Tetracenyl; Tubercidine; Xanthine; Xanthosine-5'-TP; 2-thio-zebularine; 5-aza-2-thio-zebularine; 7-deaza-2-amino-purine; pyridin-4-one ribonucleoside; 2-Amino-riboside-TP; Formycin A TP; Formycin B TP; Pyrrolosine TP; 2'-OH-ara-adenosine TP; 2'-OH-ara-cytidine TP; 2'-OH-ara-uridine TP; 2'-OH-ara-guanosine TP; 5-(2-carbomethoxyvinyl)uridine TP; and N6-(19-Amino-pentaoxanonadecyl)adenosine TP.

In some embodiments, polynucleotides (e.g., RNA polynucleotides, such as mRNA polynucleotides) include a combination of at least two (e.g., 2, 3, 4 or more) of the aforementioned modified nucleobases.

In some embodiments, modified nucleobases in polynucleotides (e.g., RNA polynucleotides, such as mRNA polynucleotides) are selected from the group consisting of pseudouridine (ψ), N1-methylpseudouridine (m$^1$ψ), N1-ethylpseudouridine, 2-thiouridine, 4'-thiouridine, 5-methylcytosine, 2-thio-1-methyl-1-deaza-pseudouridine, 2-thio-1-methyl-pseudouridine, 2-thio-5-aza-uridine, 2-thio-dihydropseudouridine, 2-thio-dihydrouridine, 2-thio-pseudouridine, 4-methoxy-2-thio-pseudouridine, 4-methoxy-pseudouridine, 4-thio-1-methyl-pseudouridine, 4-thio-pseudouridine, 5-aza-uridine, dihydropseudouridine, 5-methoxyuridine and 2'-O-methyl uridine. In some embodiments, polynucleotides (e.g., RNA polynucleotides, such as mRNA polynucleotides) include a combination of at least two (e.g., 2, 3, 4 or more) of the aforementioned modified nucleobases.

In some embodiments, modified nucleobases in polynucleotides (e.g., RNA polynucleotides, such as mRNA polynucleotides) are selected from the group consisting of 1-methyl-pseudouridine (m$^1$ψ), 5-methoxy-uridine (mo$^5$U), 5-methyl-cytidine (m$^5$C), pseudouridine (ψ), α-thio-guanosine and α-thio-adenosine. In some embodiments, polynucleotides (e.g., RNA polynucleotides, such as mRNA polynucleotides) include a combination of at least two (e.g., 2, 3, 4 or more) of the aforementioned modified nucleobases.

In some embodiments, polynucleotides (e.g., RNA polynucleotides, such as mRNA polynucleotides) comprise pseudouridine (ψ) and 5-methyl-cytidine (m$^5$C). In some embodiments, polynucleotides (e.g., RNA polynucleotides, such as mRNA polynucleotides) comprise 1-methyl-pseudouridine (m$^1$ψ). In some embodiments, polynucleotides (e.g., RNA polynucleotides, such as mRNA polynucleotides) comprise 1-methyl-pseudouridine (m$^1$ψ) and 5-methyl-cytidine (m$^5$C). In some embodiments, polynucleotides (e.g., RNA polynucleotides, such as mRNA polynucleotides) comprise 2-thiouridine (s$^2$U). In some embodiments, polynucleotides (e.g., RNA polynucleotides, such as mRNA polynucleotides) comprise 2-thiouridine and 5-methyl-cytidine (m$^5$C). In some embodiments, polynucleotides (e.g., RNA polynucleotides, such as mRNA polynucleotides) comprise methoxy-uridine (mo$^5$U). In some embodiments, polynucleotides (e.g., RNA polynucleotides, such as mRNA polynucleotides) comprise 5-methoxy-uridine (mo$^5$U) and 5-methyl-cytidine (m$^5$C). In some embodiments, polynucleotides (e.g., RNA polynucleotides, such as mRNA polynucleotides) comprise 2'-O-methyl uridine. In some embodiments polynucleotides (e.g., RNA polynucleotides, such as mRNA polynucleotides) comprise 2'-O-methyl uridine and 5-methyl-cytidine (m$^5$C). In some embodiments, polynucleotides (e.g., RNA polynucleotides, such as mRNA polynucleotides) comprise N6-methyl-adenosine (m$^6$A). In some embodiments, polynucleotides (e.g., RNA polynucleotides, such as mRNA polynucleotides) comprise N6-methyl-adenosine (m$^6$A) and 5-methyl-cytidine (m$^5$C).

In some embodiments, polynucleotides (e.g., RNA polynucleotides, such as mRNA polynucleotides) are uniformly modified (e.g., fully modified, modified throughout the entire sequence) for a particular modification. For example, a polynucleotide can be uniformly modified with 5-methyl-cytidine (m$^5$C), meaning that all cytosine residues in the mRNA sequence are replaced with 5-methyl-cytidine (m$^5$C). Similarly, a polynucleotide can be uniformly modified for any type of nucleoside residue present in the sequence by replacement with a modified residue such as those set forth above.

Exemplary nucleobases and nucleosides having a modified cytosine include N4-acetyl-cytidine (ac4C), 5-methyl-cytidine (m5C), 5-halo-cytidine (e.g., 5-iodo-cytidine), 5-hydroxymethyl-cytidine (hm5C), 1-methyl-pseudoisocytidine, 2-thio-cytidine (s2C), and 2-thio-5-methyl-cytidine.

In some embodiments, a modified nucleobase is a modified uridine. In some embodiments, a modified nucleobase is a modified cytosine. Nucleosides having a modified uridine include 5-cyano uridine, and 4'-thio uridine.

In some embodiments, a modified nucleobase is a modified adenine. Exemplary nucleobases and nucleosides having a modified adenine include 7-deaza-adenine, 1-methyl-adenosine (m1A), 2-methyl-adenine (m2A), and N6-methyl-adenosine (m6A).

In some embodiments, a modified nucleobase is a modified guanine. Exemplary nucleobases and nucleosides having a modified guanine include inosine (I), 1-methyl-inosine (mil), wyosine (imG), methylwyosine (mimG), 7-deaza-guanosine, 7-cyano-7-deaza-guanosine (preQ0), 7-aminomethyl-7-deaza-guanosine (preQ1), 7-methyl-guanosine (m7G), 1-methyl-guanosine (m1G), 8-oxo-guanosine, 7-methyl-8-oxo-guanosine.

The polynucleotides of the present disclosure may be partially or fully modified along the entire length of the molecule. For example, one or more or all or a given type of nucleotide (e.g., purine or pyrimidine, or any one or more or all of A, G, U, C) may be uniformly modified in a polynucleotide of the invention, or in a given predetermined sequence region thereof (e.g., in the mRNA including or excluding the polyA tail). In some embodiments, all nucleotides X in a polynucleotide of the present disclosure (or in a given sequence region thereof) are modified nucleotides, wherein X may any one of nucleotides A, G, U, C, or any one of the combinations A+G, A+U, A+C, G+U, G+C, U+C, A+G+U, A+G+C, G+U+C or A+G+C.

The polynucleotide may contain from about 1% to about 100% modified nucleotides (either in relation to overall nucleotide content, or in relation to one or more types of nucleotide, i.e., any one or more of A, G, U or C) or any intervening percentage (e.g., from 1% to 20%, from 1% to 25%, from 1% to 50%, from 1% to 60%, from 1% to 70%, from 1% to 80%, from 1% to 90%, from 1% to 95%, from 10% to 20%, from 10% to 25%, from 10% to 50%, from 10% to 60%, from 10% to 70%, from 10% to 80%, from 10% to 90%, from 10% to 95%, from 10% to 100%, from 20% to 25%, from 20% to 50%, from 20% to 60%, from 20% to 70%, from 20% to 80%, from 20% to 90%, from 20% to 95%, from 20% to 100%, from 50% to 60%, from 50% to 70%, from 50% to 80%, from 50% to 90%, from 50% to 95%, from 50% to 100%, from 70% to 80%, from 70% to 90%, from 70% to 95%, from 70% to 100%, from 80% to 90%, from 80% to 95%, from 80% to 100%, from 90% to 95%, from 90% to 100%, and from 95% to 100%). Any remaining percentage is accounted for by the presence of unmodified A, G, U, or C.

The polynucleotides may contain at a minimum 1% and at maximum 100% modified nucleotides, or any intervening percentage, such as at least 5% modified nucleotides, at least 10% modified nucleotides, at least 25% modified nucleotides, at least 50% modified nucleotides, at least 80% modified nucleotides, or at least 90% modified nucleotides. For example, the polynucleotides may contain a modified pyrimidine such as a modified uracil or cytosine. In some embodiments, at least 5%, at least 10%, at least 25%, at least 50%, at least 80%, at least 90% or 100% of the uracil in the polynucleotide is replaced with a modified uracil (e.g., a 5-substituted uracil). The modified uracil can be replaced by a compound having a single unique structure, or can be replaced by a plurality of compounds having different structures (e.g., 2, 3, 4 or more unique structures). In some embodiments, at least 5%, at least 10%, at least 25%, at least 50%, at least 80%, at least 90% or 100% of the cytosine in the polynucleotide is replaced with a modified cytosine (e.g., a 5-substituted cytosine). The modified cytosine can be replaced by a compound having a single unique structure, or can be replaced by a plurality of compounds having different structures (e.g., 2, 3, 4 or more unique structures).

Thus, in some embodiments, the RNA (e.g., mRNA) vaccines comprise a 5'UTR element, an optionally codon optimized open reading frame, and a 3'UTR element, a poly(A) sequence and/or a polyadenylation signal wherein the RNA is not chemically modified.

In some embodiments, the modified nucleobase is a modified uracil. Exemplary nucleobases and nucleosides having a modified uracil include pseudouridine ($\psi$), pyridin-4-one ribonucleoside, 5-aza-uridine, 6-aza-uridine, 2-thio-5-aza-uridine, 2-thio-uridine ($s^2U$), 4-thio-uridine ($s^4U$), 4-thio-pseudouridine, 2-thio-pseudouridine, 5-hydroxy-uridine ($ho^5U$), 5-aminoallyl-uridine, 5-halo-uridine (e.g., 5-iodo-uridineor 5-bromo-uridine), 3-methyl-uridine ($m^3U$), 5-methoxy-uridine ($mo^5U$), uridine 5-oxyacetic acid ($cmo^5U$), uridine 5-oxyacetic acid methyl ester ($mcmo^5U$), 5-carboxymethyl-uridine ($cm^5U$), 1-carboxymethyl-pseudouridine, 5-carboxyhydroxymethyl-uridine ($chm^5U$), 5-carboxyhydroxymethyl-uridine methyl ester ($mchm^5U$), 5-methoxycarbonylmethyl-uridine ($mcm^5U$), 5-methoxycarbonylmethyl-2-thio-uridine ($mcm^5s^2U$), 5-aminomethyl-2-thio-uridine ($nm^5s^2U$), 5-methylaminomethyl-uridine ($mnm^5U$), 5-methylaminomethyl-2-thio-uridine ($mnm^5s^2U$), 5-methylaminomethyl-2-seleno-uridine ($mnm^5se^2U$), 5-carbamoylmethyl-uridine ($ncm^5U$), 5-carboxymethylaminomethyl-uridine ($cmnm^5U$), 5-carboxymethylaminomethyl-2-thio-uridine ($cmnm^5s^2U$), 5-propynyl-uridine, 1-propynyl-pseudouridine, 5-taurinomethyl-uridine ($\tau m^5U$), 1-taurinomethyl-pseudouridine, 5-taurinomethyl-2-thio-uridine($\tau m^5s^2U$), 1-taurinomethyl-4-thio-pseudouridine, 5-methyl-uridine ($m^5U$, i.e., having the nucleobase deoxythymine), 1-methyl-pseudouridine ($m^1\psi$), 5-methyl-2-thio-uridine ($m^5s^2U$), 1-methyl-4-thio-pseudouridine ($m^1s^4\psi$), 4-thio-1-methyl-pseudouridine, 3-methyl-pseudouridine ($m^3\psi$), 2-thio-1-methyl-pseudouridine, 1-methyl-1-deaza-pseudouridine, 2-thio-1-methyl-1-deaza-pseudouridine, dihydrouridine (D), dihydropseudouridine, 5,6-dihydrouridine, 5-methyldihydrouridine ($m^5D$), 2-thio-dihydrouridine, 2-thio-dihydropseudouridine, 2-methoxy-uridine, 2-methoxy-4-thio-uridine, 4-methoxy-pseudouridine, 4-methoxy-2-thio-pseudouridine, N1-methyl-pseudouridine, 3-(3-amino-3-carboxypropyl)uridine ($acp^3U$), 1-methyl-3-(3-amino-3-carboxypropyl)pseudouridine ($acp^3\psi$), 5-(isopentenylaminomethyl)uridine ($inm^5U$), 5-(isopentenylaminomethyl)-2-thio-uridine ($inm^5s^2U$), α-thio-uridine, 2'-O-methyl-uridine (Um), 5,2'-O-dimethyl-uridine ($m^5Um$), 2'-O-methyl-pseudouridine ($\psi m$), 2-thio-2'-O-methyl-uridine ($s^2Um$), 5-methoxycarbonylmethyl-2'-O-methyl-uridine ($mcm^5Um$), 5-carbamoylmethyl-2'-O-methyl-uridine ($ncm^5Um$), 5-carboxymethylaminomethyl-2'-O-methyl-uridine ($cmnm^5Um$), 3,2'-O-dimethyl-uridine ($m^3Um$), and 5-(isopentenylaminomethyl)-2'-O-methyl-uridine ($inm^5Um$), 1-thio-uridine, deoxythymidine, 2'-F-ara-uridine, 2'-F-uridine, 2'-OH-ara-uridine, 5-(2-carbomethoxyvinyl) uridine, and 5-[3-(1-E-propenylamino)] uridine.

In some embodiments, the modified nucleobase is a modified cytosine. Exemplary nucleobases and nucleosides having a modified cytosine include 5-aza-cytidine, 6-aza-cytidine, pseudoisocytidine, 3-methyl-cytidine ($m^3C$), N4-acetyl-cytidine (act), 5-formylcytidine ($f^5C$), N4-methyl-cytidine ($m^4C$), 5-methyl-cytidine ($m^5C$), 5-halo-cytidine (e.g., 5-iodo-cytidine), 5-hydroxymethyl-cytidine ($hm^5C$), 1-methyl-pseudoisocytidine, pyrrolo-cytidine, pyrrolo-pseudoisocytidine, 2-thio-cytidine ($s^2C$), 2-thio-5-methyl-cytidine, 4-thio-pseudoisocytidine, 4-thio-1-methyl-pseudoisocytidine, 4-thio-1-methyl-1-deaza-pseudoisocytidine, 1-methyl-1-deaza-pseudoisocytidine, zebularine, 5-aza-zebularine, 5-methyl-zebularine, 5-aza-2-thio-zebularine, 2-thio-zebularine, 2-methoxy-cytidine, 2-methoxy-5-methyl-cytidine, 4-methoxy-pseudoisocytidine, 4-methoxy-1-methyl-pseudoisocytidine, lysidine ($k_2C$), α-thio-cytidine, 2'-O-methyl-cytidine (Cm), 5,2'-O-dimethyl-cytidine ($m^5Cm$), N4-acetyl-2'-O-methyl-cytidine ($ac^4Cm$), N4,2'-O-dimethyl-cytidine ($m^4Cm$), 5-formyl-2'-O-methyl-cytidine ($f^5Cm$), N4,N4,2'-O-trimethyl-cytidine ($m^4_2Cm$), 1-thio-cytidine, 2'-F-ara-cytidine, 2'-F-cytidine, and 2'-0H-ara-cytidine.

In some embodiments, the modified nucleobase is a modified adenine. Exemplary nucleobases and nucleosides having a modified adenine include 2-amino-purine, 2, 6-di-aminopurine, 2-amino-6-halo-purine (e.g., 2-amino-6-chloro-purine), 6-halo-purine (e.g., 6-chloro-purine), 2-amino-6-methyl-purine, 8-azido-adenosine, 7-deaza-adenine, 7-deaza-8-aza-adenine, 7-deaza-2-amino-purine, 7-deaza-8-aza-2-amino-purine, 7-deaza-2,6-diaminopurine, 7-deaza-8-aza-2,6-diaminopurine, 1-methyl-adenosine ($m^1A$), 2-methyl-adenine ($m^2A$), N6-methyl-adenosine ($m^6A$), 2-methylthio-N6-methyl-adenosine ($ms^2 m^6A$), N6-isopentenyl-adenosine ($i^6A$), 2-methylthio-N6-isopentenyl-adenosine ($ms^2i^6A$), N6-(cis-hydroxyisopentenyl)adenosine ($io^6A$), 2-methylthio-N6-(cis-hydroxyisopentenyl) adenosine ($ms^2io^6A$), N6-glycinylcarbamoyl-adenosine ($g^6A$), N6-threonylcarbamoyl-adenosine ($t^6A$), N6-methyl-N6-threonylcarbamoyl-adenosine ($m^6t^6A$), 2-methylthio-N6-threonylcarbamoyl-adenosine ($ms^2g^6A$), N6,N6-dimethyl-adenosine ($m^6_2A$), N6-hydroxynorvalylcarbamoyl-adenosine ($hn^6A$), 2-methylthio-N6-hydroxynorvalylcarbamoyl-adenosine ($ms^2hn^6A$), N6-acetyl-adenosine ($ac^6A$), 7-methyl-adenine, 2-methylthio-adenine, 2-methoxy-adenine, α-thio-adenosine, 2'-O-methyl-adenosine (Am), N6,2'-O-dimethyl-adenosine ($m^6Am$), N6,N6,2'-O-trimethyl-adenosine ($m^6_2Am$), 1,2'-O-dimethyl-adenosine ($m^1Am$), 2'-O-ribosyladenosine (phosphate) (Ar(p)), 2-amino-N6-methyl-purine, 1-thio-adenosine, 8-azido-adenosine, 2'-F-ara-adenosine, 2'-F-adenosine, 2'-OH-ara-adenosine, and N6-(19-amino-pentaoxanonadecyl)-adenosine.

In some embodiments, the modified nucleobase is a modified guanine. Exemplary nucleobases and nucleosides having a modified guanine include inosine (I), 1-methyl-inosine (m$^1$I), wyosine (imG), methylwyosine (mimG), 4-demethyl-wyosine (imG-14), isowyosine (imG2), wybutosine (yW), peroxywybutosine (o$_2$yW), hydroxywybutosine (OhyW), undermodified hydroxywybutosine (OhyW*), 7-deaza-guanosine, queuosine (Q), epoxyqueuosine (oQ), galactosyl-queuosine (galQ), mannosyl-queuosine (manQ), 7-cyano-7-deaza-guanosine (preQ$_0$), 7-aminomethyl-7-deaza-guanosine (preQ$_1$), archaeosine (G$^+$), 7-deaza-8-aza-guanosine, 6-thio-guanosine, 6-thio-7-deaza-guanosine, 6-thio-7-deaza-8-aza-guanosine, 7-methyl-guanosine (m$^7$G), 6-thio-7-methyl-guanosine, 7-methyl-inosine, 6-methoxy-guanosine, 1-methyl-guanosine (m$^1$G), N2-methyl-guanosine (m$^2$G), N2,N2-dimethyl-guanosine (m$^2_2$G), N2,7-dimethyl-guanosine (m$^{2,7}$G), N2, N2,7-dimethyl-guanosine (m$^{2,2,7}$G), 8-oxo-guanosine, 7-methyl-8-oxo-guanosine, 1-methyl-6-thio-guanosine, N2-methyl-6-thio-guanosine, N2,N2-dimethyl-6-thio-guanosine, α-thio-guanosine, 2'-O-methyl-guanosine (Gm), N2-methyl-2'-O-methyl-guanosine (m$^2$Gm), N2,N2-dimethyl-2'-O-methyl-guanosine (m$^2_2$Gm), 1-methyl-2'-O-methyl-guanosine (m$^1$Gm), N2,7-dimethyl-2'-O-methyl-guanosine (m$^{2,7}$Gm), 2'-O-methyl-inosine (Im), 1,2'-O-dimethyl-inosine (m$^1$Im), 2'-O-ribosylguanosine (phosphate) (Gr(p)), 1-thio-guanosine, 06-methyl-guanosine, 2'-F-ara-guanosine, and 2'-F-guanosine.

N-Linked Glycosylation Site Mutants

N-linked glycans of viral proteins play important roles in modulating the immune response. Glycans can be important for maintaining the appropriate antigenic conformations, shielding potential neutralization epitopes, and may alter the proteolytic susceptibility of proteins. Some viruses have putative N-linked glycosylation sites. Deletion or modification of an N-linked glycosylation site may enhance the immune response. Thus, the present disclosure provides, in some embodiments, RNA (e.g., mRNA) vaccines comprising nucleic acids (e.g., mRNA) encoding antigenic polypeptides that comprise a deletion or modification at one or more N-linked glycosylation sites.

In Vitro Transcription of RNA (e.g., mRNA)

Tropical disease vaccines of the present disclosure comprise at least one RNA polynucleotide, such as a mRNA (e.g., modified mRNA). mRNA, for example, is transcribed in vitro from template DNA, referred to as an "in vitro transcription template." In some embodiments, an in vitro transcription template encodes a 5' untranslated (UTR) region, contains an open reading frame, and encodes a 3' UTR and a polyA tail. The particular nucleic acid sequence composition and length of an in vitro transcription template will depend on the mRNA encoded by the template.

A "5' untranslated region" (5'UTR) refers to a region of an mRNA that is directly upstream (i.e., 5') from the start codon (i.e., the first codon of an mRNA transcript translated by a ribosome) that does not encode a polypeptide.

A "3' untranslated region" (3'UTR) refers to a region of an mRNA that is directly downstream (i.e., 3') from the stop codon (i.e., the codon of an mRNA transcript that signals a termination of translation) that does not encode a polypeptide.

An "open reading frame" is a continuous stretch of DNA beginning with a start codon (e.g., methionine (ATG)), and ending with a stop codon (e.g., TAA, TAG or TGA) and encodes a polypeptide.

A "polyA tail" is a region of mRNA that is downstream, e.g., directly downstream (i.e., 3'), from the 3' UTR that contains multiple, consecutive adenosine monophosphates. A polyA tail may contain 10 to 300 adenosine monophosphates. For example, a polyA tail may contain 10, 20, 30, 40, 50, 60, 70, 80, 90, 100, 110, 120, 130, 140, 150, 160, 170, 180, 190, 200, 210, 220, 230, 240, 250, 260, 270, 280, 290 or 300 adenosine monophosphates. In some embodiments, a polyA tail contains 50 to 250 adenosine monophosphates. In a relevant biological setting (e.g., in cells, in vivo) the poly(A) tail functions to protect mRNA from enzymatic degradation, e.g., in the cytoplasm, and aids in transcription termination, export of the mRNA from the nucleus and translation.

In some embodiments, a polynucleotide includes 200 to 3,000 nucleotides. For example, a polynucleotide may include 200 to 500, 200 to 1000, 200 to 1500, 200 to 3000, 500 to 1000, 500 to 1500, 500 to 2000, 500 to 3000, 1000 to 1500, 1000 to 2000, 1000 to 3000, 1500 to 3000, or 2000 to 3000 nucleotides.

Flagellin Adjuvants

Flagellin is an approximately 500 amino acid monomeric protein that polymerizes to form the flagella associated with bacterial motion. Flagellin is expressed by a variety of flagellated bacteria (*Salmonella typhimurium* for example) as well as non-flagellated bacteria (such as *Escherichia coli*). Sensing of flagellin by cells of the innate immune system (dendritic cells, macrophages, etc.) is mediated by the Toll-like receptor 5 (TLR5) as well as by Nod-like receptors (NLRs) Ipaf and Naip5. TLRs and NLRs have been identified as playing a role in the activation of innate immune response and adaptive immune response. As such, flagellin provides an adjuvant effect in a vaccine.

The nucleotide and amino acid sequences encoding known flagellin polypeptides are publicly available in the NCBI GenBank database. The flagellin sequences from *S. Typhimurium, H. Pylori, V. Cholera, S. marcesens, S. flexneri, T. pallidum, L. pneumophila, B. burgdorferei, C. difficile, R. meliloti, A. tumefaciens, R. lupini, B. clarridgeiae, P. Mirabilis, B. subtilus, L. monocytogenes, P. aeruginosa*, and *E. coli*, among others are known.

A flagellin polypeptide, as used herein, refers to a full length flagellin protein, immunogenic fragments thereof, and peptides having at least 50% sequence identity to a flagellin protein or immunogenic fragments thereof. Exemplary flagellin proteins include flagellin from *Salmonella typhi* (UniPro Entry number: Q56086), *Salmonella typhimurium* (A0A0C9DG09), *Salmonella enteritidis* (A0A0C9BAB7), and *Salmonella choleraesuis* (Q6V2X8), and proteins having an amino acid sequence identified by any one of SEQ ID NO: 420-422 (Table 66). In some embodiments, the flagellin polypeptide has at least 60%, 70%, 75%, 80%, 90%, 95%, 97%, 98%, or 99% sequence identity to a flagellin protein or immunogenic fragments thereof.

In some embodiments, the flagellin polypeptide is an immunogenic fragment. An immunogenic fragment is a portion of a flagellin protein that provokes an immune response. In some embodiments, the immune response is a TLR5 immune response. An example of an immunogenic fragment is a flagellin protein in which all or a portion of a hinge region has been deleted or replaced with other amino acids. For example, an antigenic polypeptide may be inserted in the hinge region. Hinge regions are the hypervariable regions of a flagellin. Hinge regions of a flagellin are also referred to as "D3 domain or region," "propeller domain or region," "hypervariable domain or region" and "variable domain or region." "At least a portion of a hinge region," as used herein, refers to any part of the hinge region of the flagellin, or the entirety of the hinge region. In other embodiments an immunogenic fragment of flagellin is a 20, 25, 30, 35, or 40 amino acid C-terminal fragment of flagellin.

The flagellin monomer is formed by domains D0 through D3. D0 and D1, which form the stem, are composed of tandem long alpha helices and are highly conserved among different bacteria. The D1 domain includes several stretches of amino acids that are useful for TLR5 activation. The entire D1 domain or one or more of the active regions within the domain are immunogenic fragments of flagellin. Examples of immunogenic regions within the D1 domain include residues 88-114 and residues 411-431 in *Salmonella typhimurium* FliC flagellin. Within the 13 amino acids in the 88-100 region, at least 6 substitutions are permitted between *Salmonella* flagellin and other flagellins that still preserve TLR5 activation. Thus, immunogenic fragments of flagellin include flagellin like sequences that activate TLR5 and contain a 13 amino acid motif that is 53% or more identical to the *Salmonella* sequence in 88-100 of FliC (LQRVRELAVQSAN; SEQ ID NO: 428).

In some embodiments, the RNA (e.g., mRNA) vaccine includes an RNA that encodes a fusion protein of flagellin and one or more antigenic polypeptides. A "fusion protein" as used herein, refers to a linking of two components of the construct. In some embodiments, a carboxy-terminus of the antigenic polypeptide is fused or linked to an amino terminus of the flagellin polypeptide. In other embodiments, an amino-terminus of the antigenic polypeptide is fused or linked to a carboxy-terminus of the flagellin polypeptide. The fusion protein may include, for example, one, two, three, four, five, six or more flagellin polypeptides linked to one, two, three, four, five, six or more antigenic polypeptides. When two or more flagellin polypeptides and/or two or more antigenic polypeptides are linked such a construct may be referred to as a "multimer."

Each of the components of a fusion protein may be directly linked to one another or they may be connected through a linker. For instance, the linker may be an amino acid linker. The amino acid linker encoded for by the RNA (e.g., mRNA) vaccine to link the components of the fusion protein may include, for instance, at least one member selected from the group consisting of a lysine residue, a glutamic acid residue, a serine residue and an arginine residue. In some embodiments the linker is 1-30, 1-25, 1-25, 5-10, 5, 15, or 5-20 amino acids in length.

In other embodiments the RNA (e.g., mRNA) vaccine includes at least two separate RNA polynucleotides, one encoding one or more antigenic polypeptides and the other encoding the flagellin polypeptide. The at least two RNA polynucleotides may be coformulated in a carrier such as a lipid nanoparticle.

Broad Spectrum RNA (e.g., mRNA) Vaccines

There may be situations where persons are at risk for infection with more than one strain of Malaria (e.g., *P. falciparum, P. vivax, P. malariae* and/or *P. ovale*), JEV, WNV, EEEV, VEEV, SINV, CHIKV, DENV, ZIKV and/or YFV. RNA (e.g., mRNA) therapeutic vaccines are particularly amenable to combination vaccination approaches due to a number of factors including, but not limited to, speed of manufacture, ability to rapidly tailor vaccines to accommodate perceived geographical threat, and the like. Moreover, because the vaccines utilize the human body to produce the antigenic protein, the vaccines are amenable to the production of larger, more complex antigenic proteins, allowing for proper folding, surface expression, antigen presentation, etc. in the human subject. To protect against more than one strain of Malaria (e.g., *P. falciparum, P. vivax, P. malariae* and/or *P. ovale*), JEV, WNV, EEEV, VEEV, SINV, CHIKV, DENV, ZIKV and/or YFV, a combination vaccine can be administered that includes RNA (e.g., mRNA) encoding at least one antigenic polypeptide protein (or antigenic portion thereof) of a first tropical disease virus or organism and further includes RNA encoding at least one antigenic polypeptide protein (or antigenic portion thereof) of a second tropical disease virus or organism. RNA (e.g., mRNA) can be coformulated, for example, in a single lipid nanoparticle (LNP) or can be formulated in separate LNPs for co-administration.

Methods of Treatment

Provided herein are compositions (e.g., pharmaceutical compositions), methods, kits and reagents for prevention and/or treatment of tropical diseases in humans and other mammals Tropical disease RNA (e.g. mRNA) vaccines can be used as therapeutic or prophylactic agents, alone or in combination with other vaccine(s). They may be used in medicine to prevent and/or treat tropical disease. In exemplary aspects, the RNA (e.g., mRNA) vaccines of the present disclosure are used to provide prophylactic protection from Malaria (e.g., *P. falciparum, P. vivax, P. malariae* and/or *P. ovale*), JEV, WNV, EEEV, VEEV, SINV, CHIKV, DENV, ZIKV and/or YFV. Prophylactic protection from Malaria (e.g., *P. falciparum, P. vivax, P. malariae* and/or *P. ovale*), JEV, WNV, EEEV, VEEV, SINV, CHIKV, DENV, ZIKV and/or YFV can be achieved following administration of a RNA (e.g., mRNA) vaccine of the present disclosure. Tropical disease RNA (e.g., mRNA) vaccines of the present disclosure may be used to treat or prevent viral "co-infections" containing two or more tropical disease infections. Vaccines can be administered once, twice, three times, four times or more, but it is likely sufficient to administer the vaccine once (optionally followed by a single booster). It is possible, although less desirable, to administer the vaccine to an infected individual to achieve a therapeutic response. Dosing may need to be adjusted accordingly.

A method of eliciting an immune response in a subject against Malaria (e.g., *P. falciparum, P. vivax, P. malariae* and/or *P. ovale*), JEV, WNV, EEEV, VEEV, SINV, CHIKV, DENV, ZIKV and/or YFV is provided in aspects of the present disclosure. The method involves administering to the subject a tropical disease RNA (e.g., mRNA) vaccine comprising at least one RNA (e.g., mRNA) polynucleotide having an open reading frame encoding at least one Malaria (e.g., *P. falciparum, P. vivax, P. malariae* and/or *P. ovale*), JEV, WNV, EEEV, VEEV, SINV, CHIKV, DENV, ZIKV and/or YFV antigenic polypeptide, thereby inducing in the subject an immune response specific to Malaria (e.g., *P. falciparum, P. vivax, P. malariae* and/or *P. ovale*), JEV, WNV, EEEV, VEEV, SINV, CHIKV, DENV, ZIKV and/or YFV antigenic polypeptide or an immunogenic fragment thereof, wherein anti-antigenic polypeptide antibody titer in the subject is increased following vaccination relative to anti-antigenic polypeptide antibody titer in a subject vaccinated with a prophylactically effective dose of a traditional vaccine against Malaria (e.g., *P. falciparum, P. vivax, P. malariae* and/or *P. ovale*), JEV, WNV, EEEV, VEEV, SINV, CHIKV, DENV, ZIKV and/or YFV. An "anti-antigenic polypeptide antibody" is a serum antibody the binds specifically to the antigenic polypeptide.

In some embodiments, a RNA (e.g., mRNA) vaccine (e.g., a Malaria (e.g., *P. falciparum, P. vivax, P. malariae* and/or *P. ovale*), JEV, WNV, EEEV, VEEV, SINV, CHIKV, DENV, ZIKV and/or YFV RNA vaccine) capable of eliciting an immune response is administered intramuscularly or intranasally via a composition including a compound according to Formula (I), (IA), (II), (IIa), (IIb), (IIc), (IId) or (IIe) (e.g., Compound 3, 18, 20, 25, 26, 29, 30, 60, 108-112, or 122).

A prophylactically effective dose is a therapeutically effective dose that prevents infection with the virus at a clinically acceptable level. In some embodiments the therapeutically effective dose is a dose listed in a package insert for the vaccine. A traditional vaccine, as used herein, refers to a vaccine other than the RNA (e.g., mRNA) vaccines of the present disclosure. For instance, a traditional vaccine includes but is not limited to live/attenuated microorganism vaccines, killed/inactivated microorganism vaccines, subunit vaccines, protein antigen vaccines, DNA vaccines, VLP vaccines, etc. In exemplary embodiments, a traditional vaccine is a vaccine that has achieved regulatory approval and/or is registered by a national drug regulatory body, for example the Food and Drug Administration (FDA) in the United States or the European Medicines Agency (EMA).

In some embodiments the anti-antigenic polypeptide antibody titer in the subject is increased 1 log to 10 log following vaccination relative to anti-antigenic polypeptide antibody titer in a subject vaccinated with a prophylactically effective dose of a traditional vaccine against Malaria (e.g., *P. falciparum, P. vivax, P. malariae* and/or *P. ovale*), JEV, WNV, EEEV, VEEV, SINV, CHIKV, DENV, ZIKV and/or YFV.

In some embodiments the anti-antigenic polypeptide antibody titer in the subject is increased 1 log, 2 log, 3 log, 5 log or 10 log following vaccination relative to anti-antigenic polypeptide antibody titer in a subject vaccinated with a prophylactically effective dose of a traditional vaccine against Malaria (e.g., *P. falciparum, P. vivax, P. malariae* and/or *P. ovale*), JEV, WNV, EEEV, VEEV, SINV, CHIKV, DENV, ZIKV and/or YFV.

A method of eliciting an immune response in a subject against Malaria (e.g., *P. falciparum, P. vivax, P. malariae* and/or *P. ovale*), JEV, WNV, EEEV, VEEV, SINV, CHIKV, DENV, ZIKV and/or YFV is provided in other aspects of the disclosure. The method involves administering to the subject a tropical disease RNA (e.g., mRNA) vaccine comprising at least one RNA (e.g., mRNA) polynucleotide having an open reading frame encoding at least one Malaria (e.g., *P. falciparum, P. vivax, P. malariae* and/or *P. ovale*), JEV, WNV, EEEV, VEEV, SINV, CHIKV, DENV, ZIKV and/or YFV antigenic polypeptide or an immunogenic fragment thereof, thereby inducing in the subject an immune response specific to Malaria (e.g., *P. falciparum, P. vivax, P. malariae* and/or *P. ovale*), JEV, WNV, EEEV, VEEV, SINV, CHIKV, DENV, ZIKV and/or YFV antigenic polypeptide or an immunogenic fragment thereof, wherein the immune response in the subject is equivalent to an immune response in a subject vaccinated with a traditional vaccine against the Malaria (e.g., *P. falciparum, P. vivax, P. malariae* and/or *P. ovale*), JEV, WNV, EEEV, VEEV, SINV, CHIKV, DENV, ZIKV and/or YFV at 2 times to 100 times the dosage level relative to the RNA (e.g., mRNA) vaccine.

In some embodiments, the immune response in the subject is equivalent to an immune response in a subject vaccinated with a traditional vaccine at 2, 3, 4, 5, 10, 50, 100 times the dosage level relative to the Malaria (e.g., *P. falciparum, P. vivax, P. malariae* and/or *P. ovale*), JEV, WNV, EEEV, VEEV, SINV, CHIKV, DENV, ZIKV and/or YFV RNA (e.g., mRNA) vaccine.

In some embodiments the immune response in the subject is equivalent to an immune response in a subject vaccinated with a traditional vaccine at 10-100 times, or 100-1000 times, the dosage level relative to the Malaria (e.g., *P. falciparum, P. vivax, P. malariae* and/or *P. ovale*), JEV, WNV, EEEV, VEEV, SINV, CHIKV, DENV, ZIKV and/or YFV RNA (e.g., mRNA) vaccine.

In some embodiments the immune response is assessed by determining protein antibody titer in the subject.

Some embodiments provide a method of inducing an immune response in a subject by administering to the subject a tropical disease RNA (e.g., mRNA) vaccine comprising at least one RNA (e.g., mRNA) polynucleotide having an open reading frame encoding at least one Malaria (e.g., *P. falciparum, P. vivax, P. malariae* and/or *P. ovale*), JEV, WNV, EEEV, VEEV, SINV, CHIKV, DENV, ZIKV and/or YFV antigenic polypeptide, thereby inducing in the subject an immune response specific to the antigenic polypeptide or an immunogenic fragment thereof, wherein the immune response in the subject is induced 2 days to 10 weeks earlier relative to an immune response induced in a subject vaccinated with a prophylactically effective dose of a traditional vaccine against Malaria (e.g., *P. falciparum, P. vivax, P. malariae* and/or *P. ovale*), JEV, WNV, EEEV, VEEV, SINV, CHIKV, DENV, ZIKV and/or YFV. In some embodiments, the immune response in the subject is induced in a subject vaccinated with a prophylactically effective dose of a traditional vaccine at 2 times to 100 times the dosage level relative to the RNA (e.g., mRNA) vaccine.

In some embodiments the immune response in the subject is equivalent to an immune response in a subject vaccinated with a traditional vaccine at 2, 3, 4, 5, 10, 50, 100 times the dosage level relative to the Malaria (e.g., *P. falciparum, P. vivax, P. malariae* and/or *P. ovale*), JEV, WNV, EEEV, VEEV, SINV, CHIKV, DENV, ZIKV and/or YFV RNA (e.g., mRNA) vaccine.

In some embodiments, the immune response in the subject is induced 2 days earlier, or 3 days earlier, relative to an immune response induced in a subject vaccinated with a prophylactically effective dose of a traditional vaccine.

In some embodiments the immune response in the subject is induced 1 week, 2 weeks, 3 weeks, 5 weeks, or 10 weeks earlier relative to an immune response induced in a subject vaccinated with a prophylactically effective dose of a traditional vaccine.

Therapeutic and Prophylactic Compositions

Provided herein are compositions (e.g., pharmaceutical compositions), methods, kits and reagents for prevention, treatment or diagnosis of Malaria (e.g., *P. falciparum, P. vivax, P. malariae* and/or *P. ovale*), JEV, WNV, EEEV, VEEV, SINV, CHIKV, DENV, ZIKV and/or YFV in humans and other mammals, for example. Tropical disease RNA (e.g. mRNA) vaccines can be used as therapeutic or prophylactic agents. They may be used in medicine to prevent and/or treat infectious disease. In some embodiments, the RNA (e.g., mRNA) vaccines of the present disclosure are used fin the priming of immune effector cells, for example, to activate peripheral blood mononuclear cells (PBMCs) ex vivo, which are then infused (re-infused) into a subject.

In some embodiments, tropical disease vaccine containing RNA (e.g., mRNA) polynucleotides as described herein can be administered to a subject (e.g., a mammalian subject, such as a human subject), and the RNA (e.g., mRNA) polynucleotides are translated in vivo to produce an antigenic polypeptide.

The tropical disease RNA (e.g., mRNA) vaccines may be induced for translation of a polypeptide (e.g., antigen or immunogen) in a cell, tissue or organism. In some embodiments, such translation occurs in vivo, although such translation may occur ex vivo, in culture or in vitro. In some embodiments, the cell, tissue or organism is contacted with an effective amount of a composition containing a tropical disease RNA (e.g., mRNA) vaccine that contains a polynucleotide that has at least one a translatable region encoding an antigenic polypeptide.

An "effective amount" of a tropical disease RNA (e.g. mRNA) vaccine is provided based, at least in part, on the target tissue, target cell type, means of administration, physical characteristics of the polynucleotide (e.g., size, and extent of modified nucleosides) and other components of the vaccine, and other determinants. In general, an effective amount of the tropical disease RNA (e.g., mRNA) vaccine composition provides an induced or boosted immune response as a function of antigen production in the cell, preferably more efficient than a composition containing a corresponding unmodified polynucleotide encoding the same antigen or a peptide antigen. Increased antigen production may be demonstrated by increased cell transfection (the percentage of cells transfected with the RNA, e.g., mRNA, vaccine), increased protein translation from the polynucleotide, decreased nucleic acid degradation (as demonstrated, for example, by increased duration of protein translation from a modified polynucleotide), or altered antigen specific immune response of the host cell.

In some embodiments, RNA (e.g. mRNA) vaccines (including polynucleotides their encoded polypeptides) in accordance with the present disclosure may be used for treatment of Malaria (e.g., *P. falciparum, P. vivax, P. malariae* and/or *P. ovale*), JEV, WNV, EEEV, VEEV, SINV, CHIKV, DENV, ZIKV and/or YFV.

Tropical disease RNA (e.g. mRNA) vaccines may be administered prophylactically or therapeutically as part of an active immunization scheme to healthy individuals or early in infection during the incubation phase or during active infection after onset of symptoms. In some embodiments, the amount of RNA (e.g., mRNA) vaccine of the present disclosure provided to a cell, a tissue or a subject may be an amount effective for immune prophylaxis.

Tropical disease RNA (e.g. mRNA) vaccines may be administrated with other prophylactic or therapeutic compounds. As a non-limiting example, a prophylactic or therapeutic compound may be an adjuvant or a booster. As used herein, when referring to a prophylactic composition, such as a vaccine, the term "booster" refers to an extra administration of the prophylactic (vaccine) composition. A booster (or booster vaccine) may be given after an earlier administration of the prophylactic composition. The time of administration between the initial administration of the prophylactic composition and the booster may be, but is not limited to, 1 minute, 2 minutes, 3 minutes, 4 minutes, 5 minutes, 6 minutes, 7 minutes, 8 minutes, 9 minutes, 10 minutes, 15 minutes, 20 minutes 35 minutes, 40 minutes, 45 minutes, 50 minutes, 55 minutes, 1 hour, 2 hours, 3 hours, 4 hours, 5 hours, 6 hours, 7 hours, 8 hours, 9 hours, 10 hours, 11 hours, 12 hours, 13 hours, 14 hours, 15 hours, 16 hours, 17 hours, 18 hours, 19 hours, 20 hours, 21 hours, 22 hours, 23 hours, 1 day, 36 hours, 2 days, 3 days, 4 days, 5 days, 6 days, 1 week, 10 days, 2 weeks, 3 weeks, 1 month, 2 months, 3 months, 4 months, 5 months, 6 months, 7 months, 8 months, 9 months, 10 months, 11 months, 1 year, 18 months, 2 years, 3 years, 4 years, 5 years, 6 years, 7 years, 8 years, 9 years, 10 years, 11 years, 12 years, 13 years, 14 years, 15 years, 16 years, 17 years, 18 years, 19 years, 20 years, 25 years, 30 years, 35 years, 40 years, 45 years, 50 years, 55 years, 60 years, 65 years, 70 years, 75 years, 80 years, 85 years, 90 years, 95 years or more than 99 years. In some embodiments, the time of administration between the initial administration of the prophylactic composition and the booster may be, but is not limited to, 1 week, 2 weeks, 3 weeks, 1 month, 2 months, 3 months, 6 months or 1 year.

In some embodiments, tropical disease RNA (e.g. mRNA) vaccines may be administered intramuscularly, intradermally, or intranasally, similarly to the administration of inactivated vaccines known in the art.

Tropical disease RNA (e.g. mRNA) vaccines may be utilized in various settings depending on the prevalence of the infection or the degree or level of unmet medical need. As a non-limiting example, the RNA (e.g., mRNA) vaccines may be utilized to treat and/or prevent a variety of tropical diseases. RNA (e.g., mRNA) vaccines have superior properties in that they produce much larger antibody titers and produce responses early than commercially available antiviral agents/compositions.

Provided herein are pharmaceutical compositions including tropical disease RNA (e.g. mRNA) vaccines and RNA (e.g. mRNA) vaccine compositions and/or complexes optionally in combination with one or more pharmaceutically acceptable excipients.

Malaria (e.g., *P. falciparum, P. vivax, P. malariae* and/or *P. ovale*), JEV, WNV, EEEV, VEEV, SINV, CHIKV, DENV, ZIKV and/or YFV RNA (e.g. mRNA) vaccines may be formulated or administered alone or in conjunction with one or more other components. For instance, Malaria (e.g., *P. falciparum, P. vivax, P. malariae* and/or P. ovale), JEV, WNV, EEEV, VEEV, SINV, CHIKV, DENV, ZIKV and/or YFV RNA (e.g., mRNA) vaccines (vaccine compositions) may comprise other components including, but not limited to, adjuvants.

In some embodiments, tropical disease (e.g. mRNA) vaccines do not include an adjuvant (they are adjuvant free).

Tropical disease RNA (e.g. mRNA) vaccines may be formulated or administered in combination with one or more pharmaceutically-acceptable excipients. In some embodiments, vaccine compositions comprise at least one additional active substances, such as, for example, a therapeutically-active substance, a prophylactically-active substance, or a combination of both. Vaccine compositions may be sterile, pyrogen-free or both sterile and pyrogen-free. General considerations in the formulation and/or manufacture of pharmaceutical agents, such as vaccine compositions, may be found, for example, in Remington: The Science and Practice of Pharmacy 21st ed., Lippincott Williams & Wilkins, 2005 (incorporated herein by reference in its entirety).

In some embodiments, tropical disease RNA (e.g. mRNA) vaccines are administered to humans, human patients or subjects. For the purposes of the present disclosure, the phrase "active ingredient" generally refers to the RNA (e.g., mRNA) vaccines or the polynucleotides contained therein, for example, RNA polynucleotides (e.g., mRNA polynucleotides) encoding antigenic polypeptides.

Formulations of the tropical disease vaccine compositions described herein may be prepared by any method known or hereafter developed in the art of pharmacology. In general, such preparatory methods include the step of bringing the active ingredient (e.g., mRNA polynucleotide) into association with an excipient and/or one or more other accessory ingredients, and then, if necessary and/or desirable, dividing, shaping and/or packaging the product into a desired single- or multi-dose unit.

Relative amounts of the active ingredient, the pharmaceutically acceptable excipient, and/or any additional ingredients in a pharmaceutical composition in accordance with the disclosure will vary, depending upon the identity, size, and/or condition of the subject treated and further depending upon the route by which the composition is to be administered. By way of example, the composition may comprise between 0.1% and 100%, e.g., between 0.5 and 50%, between 1-30%, between 5-80%, at least 80% (w/w) active ingredient.

Tropical disease RNA (e.g. mRNA) vaccines can be formulated using one or more excipients to: increase stability; increase cell transfection; permit the sustained or delayed release (e.g., from a depot formulation); alter the biodistribution (e.g., target to specific tissues or cell types); increase the translation of encoded protein in vivo; and/or alter the release profile of encoded protein (antigen) in vivo. In addition to traditional excipients such as any and all solvents, dispersion media, diluents, or other liquid vehicles, dispersion or suspension aids, surface active agents, isotonic agents, thickening or emulsifying agents, preservatives, excipients can include, without limitation, lipidoids, liposomes, lipid nanoparticles, polymers, lipoplexes, core-shell nanoparticles, peptides, proteins, cells transfected with tropical disease RNA (e.g. mRNA) vaccines (e.g., for transplantation into a subject), hyaluronidase, nanoparticle mimics and combinations thereof.

Stabilizing Elements

Naturally-occurring eukaryotic mRNA molecules have been found to contain stabilizing elements, including, but not limited to untranslated regions (UTR) at their 5'-end (5'UTR) and/or at their 3'-end (3'UTR), in addition to other structural features, such as a 5'-cap structure or a 3'-poly(A) tail. Both the 5'UTR and the 3'UTR are typically transcribed from the genomic DNA and are elements of the premature mRNA. Characteristic structural features of mature mRNA, such as the 5'-cap and the 3'-poly(A) tail are usually added to the transcribed (premature) mRNA during mRNA processing. The 3'-poly(A) tail is typically a stretch of adenine nucleotides added to the 3'-end of the transcribed mRNA. It can comprise up to about 400 adenine nucleotides. In some embodiments the length of the 3'-poly(A) tail may be an essential element with respect to the stability of the individual mRNA.

In some embodiments the RNA (e.g., mRNA) vaccine may include one or more stabilizing elements. Stabilizing elements may include for instance a histone stem-loop. A stem-loop binding protein (SLBP), a 32 kDa protein has been identified. It is associated with the histone stem-loop at the 3'-end of the histone messages in both the nucleus and the cytoplasm. Its expression level is regulated by the cell cycle; it peaks during the S-phase, when histone mRNA levels are also elevated. The protein has been shown to be essential for efficient 3'-end processing of histone pre-mRNA by the U7 snRNP. SLBP continues to be associated with the stem-loop after processing, and then stimulates the translation of mature histone mRNAs into histone proteins in the cytoplasm. The RNA binding domain of SLBP is conserved through metazoa and protozoa; its binding to the histone stem-loop depends on the structure of the loop. The minimum binding site includes at least three nucleotides 5' and two nucleotides 3' relative to the stem-loop.

In some embodiments, the RNA (e.g., mRNA) vaccines include a coding region, at least one histone stem-loop, and optionally, a poly(A) sequence or polyadenylation signal. The poly(A) sequence or polyadenylation signal generally should enhance the expression level of the encoded protein. The encoded protein, in some embodiments, is not a histone protein, a reporter protein (e.g. Luciferase, GFP, EGFP, β-Galactosidase, EGFP), or a marker or selection protein (e.g. alpha-Globin, Galactokinase and Xanthine:guanine phosphoribosyl transferase (GPT)).

In some embodiments, the combination of a poly(A) sequence or polyadenylation signal and at least one histone stem-loop, even though both represent alternative mechanisms in nature, acts synergistically to increase the protein expression beyond the level observed with either of the individual elements. It has been found that the synergistic effect of the combination of poly(A) and at least one histone stem-loop does not depend on the order of the elements or the length of the poly(A) sequence.

In some embodiments, the RNA (e.g., mRNA) vaccine does not comprise a histone downstream element (HDE). "Histone downstream element" (HDE) includes a purine-rich polynucleotide stretch of approximately 15 to 20 nucleotides 3' of naturally occurring stem-loops, representing the binding site for the U7 snRNA, which is involved in processing of histone pre-mRNA into mature histone mRNA. Ideally, the inventive nucleic acid does not include an intron.

In some embodiments, the RNA (e.g., mRNA) vaccine may or may not contain an enhancer and/or promoter sequence, which may be modified or unmodified or which may be activated or inactivated. In some embodiments, the histone stem-loop is generally derived from histone genes, and includes an intramolecular base pairing of two neighbored partially or entirely reverse complementary sequences separated by a spacer, including (e.g., consisting of) a short sequence, which forms the loop of the structure. The unpaired loop region is typically unable to base pair with either of the stem loop elements. It occurs more often in RNA, as is a key component of many RNA secondary structures, but may be present in single-stranded DNA as well. Stability of the stem-loop structure generally depends on the length, number of mismatches or bulges, and base composition of the paired region. In some embodiments, wobble base pairing (non-Watson-Crick base pairing) may result. In some embodiments, the at least one histone stem-loop sequence comprises a length of 15 to 45 nucleotides.

In other embodiments the RNA (e.g., mRNA) vaccine may have one or more AU-rich sequences removed. These sequences, sometimes referred to as AURES, are destabilizing sequences found in the 3'UTR. The AURES may be removed from the RNA (e.g., mRNA) vaccines. Alternatively the AURES may remain in the RNA (e.g., mRNA) vaccine.

Nanoparticle Formulations

In some embodiments, tropical disease RNA (e.g. mRNA) vaccines are formulated in a nanoparticle. In some embodiments, tropical disease RNA (e.g. mRNA) vaccines are formulated in a lipid nanoparticle. In some embodiments, tropical disease RNA (e.g. mRNA) vaccines are formulated in a lipid-polycation complex, referred to as a cationic lipid nanoparticle. As a non-limiting example, the polycation may include a cationic peptide or a polypeptide such as, but not limited to, polylysine, polyornithine and/or polyarginine. In some embodiments, tropical disease RNA (e.g., mRNA) vaccines are formulated in a lipid nanoparticle that includes a non-cationic lipid such as, but not limited to, cholesterol or dioleoyl phosphatidylethanolamine (DOPE).

A lipid nanoparticle formulation may be influenced by, but not limited to, the selection of the cationic lipid component, the degree of cationic lipid saturation, the nature of the PEGylation, ratio of all components and biophysical parameters such as size. In one example by Semple et al. (*Nature Biotech.* 2010 28:172-176), the lipid nanoparticle formulation is composed of 57.1% cationic lipid, 7.1% dipalmitoylphosphatidylcholine, 34.3% cholesterol, and 1.4% PEG-c-DMA. As another example, changing the composition of the cationic lipid can more effectively deliver siRNA to various antigen presenting cells (Basha et al. *Mol Ther.* 2011 19:2186-2200).

In some embodiments, lipid nanoparticle formulations may comprise 35 to 45% cationic lipid, 40% to 50% cationic lipid, 50% to 60% cationic lipid and/or 55% to 65% cationic lipid. In some embodiments, the ratio of lipid to RNA (e.g., mRNA) in lipid nanoparticles may be 5:1 to 20:1, 10:1 to 25:1, 15:1 to 30:1 and/or at least 30:1.

In some embodiments, the ratio of PEG in the lipid nanoparticle formulations may be increased or decreased and/or the carbon chain length of the PEG lipid may be modified from C14 to C18 to alter the pharmacokinetics and/or biodistribution of the lipid nanoparticle formulations. As a non-limiting example, lipid nanoparticle formulations may contain 0.5% to 3.0%, 1.0% to 3.5%, 1.5% to 4.0%, 2.0% to 4.5%, 2.5% to 5.0% and/or 3.0% to 6.0% of the lipid molar ratio of PEG-c-DOMG (R-3-[(ω-methoxy-poly(ethyleneglycol)2000)carbamoyl)]-1,2-dimyristyloxypropyl-3-amine) (also referred to herein as PEG-DOMG) as compared to the cationic lipid, DSPC and cholesterol. In some embodiments, the PEG-c-DOMG may be replaced with a PEG lipid such as, but not limited to, PEG-DSG (1,2-Distearoyl-sn-glycerol, methoxypolyethylene glycol), PEG-DMG (1,2-Dimyristoyl-sn-glycerol) and/or PEG-DPG (1,2-Dipalmitoyl-sn-glycerol, methoxypolyethylene glycol). The cationic lipid may be selected from any lipid known in the art such as, but not limited to, DLin-MC3-DMA, DLin-DMA, C12-200 and DLin-KC2-DMA.

In some embodiments, a tropical disease RNA (e.g. mRNA) vaccine formulation is a nanoparticle that comprises at least one lipid. The lipid may be selected from, but is not limited to, DLin-DMA, DLin-K-DMA, 98N12-5, C12-200, DLin-MC3-DMA, DLin-KC2-DMA, DODMA, PLGA, PEG, PEG-DMG, PEGylated lipids and amino alcohol lipids. In some embodiments, the lipid may be a cationic lipid such as, but not limited to, DLin-DMA, DLin-D-DMA, DLin-MC3-DMA, DLin-KC2-DMA, DODMA and amino alcohol lipids. The amino alcohol cationic lipid may be the lipids described in and/or made by the methods described in U.S. Patent Publication No. US20130150625, herein incorporated by reference in its entirety. As a non-limiting example, the cationic lipid may be 2-amino-3-[(9Z,12Z)-octadeca-9,12-dien-1-yloxy]-2-{[(9Z,2Z)-octadeca-9,12-dien-1-yloxy]methyl}propan-1-ol (Compound 1 in US20130150625); 2-amino-3-[(9Z)-octadec-9-en-1-yloxy]-2-{[(9Z)-octadec-9-en-1-yloxy]methyl}propan-1-ol (Compound 2 in US20130150625); 2-amino-3-[(9Z,12Z)-octadeca-9,12-dien-1-yloxy]-2-[(octyloxy)methyl]propan-1-ol (Compound 3 in US20130150625); and 2-(dimethylamino)-3-[(9Z,12Z)-octadeca-9,12-dien-1-yloxy]-2-{[(9Z,12Z)-octadeca-9,12-dien-1-yloxy]methyl}propan-1-ol (Compound 4 in US20130150625); or any pharmaceutically acceptable salt or stereoisomer thereof.

Lipid nanoparticle formulations typically comprise a lipid, in particular, an ionizable cationic lipid, for example, 2,2-dilinoleyl-4-dimethylaminoethyl-[1,3]-dioxolane (DLin-KC2-DMA), dilinoleyl-methyl-4-dimethylaminobutyrate (DLin-MC3-DMA), or di((Z)-non-2-en-1-yl) 9-((4-(dimethylamino)butanoyl)oxy)heptadecanedioate (L319), and further comprise a neutral lipid, a sterol and a molecule capable of reducing particle aggregation, for example a PEG or PEG-modified lipid.

In some embodiments, a lipid nanoparticle formulation consists essentially of (i) at least one lipid selected from the group consisting of 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate (L319); (ii) a neutral lipid selected from DSPC, DPPC, POPC, DOPE and SM; (iii) a sterol, e.g., cholesterol; and (iv) a PEG-lipid, e.g., PEG-DMG or PEG-cDMA, in a molar ratio of 20-60% cationic lipid:5-25% neutral lipid:25-55% sterol; 0.5-15% PEG-lipid.

In some embodiments, a lipid nanoparticle formulation includes 25% to 75% on a molar basis of a cationic lipid selected from 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate (L319), e.g., 35% to 65%, 45% to 65%, 60%, 57.5%, 50% or 40% on a molar basis.

In some embodiments, a lipid nanoparticle formulation includes 0.5% to 15% on a molar basis of the neutral lipid, e.g., 3% to 12%, 5% to 10% or 15%, 10%, or 7.5% on a molar basis. Examples of neutral lipids include, without limitation, DSPC, POPC, DPPC, DOPE and SM. In some embodiments, the formulation includes 5% to 50% on a molar basis of the sterol (e.g., 15% to 45%, 20% to 40%, 40%, 38.5%, 35%, or 31% on a molar basis). A non-limiting example of a sterol is cholesterol. In some embodiments, a lipid nanoparticle formulation includes 0.5% to 20% on a molar basis of the PEG or PEG-modified lipid (e.g., 0.5% to 10%, 0.5% to 5%, 1.5%, 0.5%, 1.5%, 3.5%, or 5% on a molar basis). In some embodiments, a PEG or PEG modified lipid comprises a PEG molecule of an average molecular weight of 2,000 Da. In some embodiments, a PEG or PEG modified lipid comprises a PEG molecule of an average molecular weight of less than 2,000, for example around 1,500 Da, around 1,000 Da, or around 500 Da. Non-limiting examples of PEG-modified lipids include PEG-distearoyl glycerol (PEG-DMG) (also referred herein as PEG-C14 or C14-PEG), PEG-cDMA (further discussed in Reyes et al. *J. Controlled Release*, 107, 276-287 (2005) the contents of which are herein incorporated by reference in their entirety).

In some embodiments, lipid nanoparticle formulations include 25-75% of a cationic lipid selected from 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate (L319), 0.5-15% of the neutral lipid, 5-50% of the sterol, and 0.5-20% of the PEG or PEG-modified lipid on a molar basis.

In some embodiments, lipid nanoparticle formulations include 35-65% of a cationic lipid selected from 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate (L319), 3-12% of the neutral lipid, 15-45% of the sterol, and 0.5-10% of the PEG or PEG-modified lipid on a molar basis.

In some embodiments, lipid nanoparticle formulations include 45-65% of a cationic lipid selected from 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate (L319), 5-10% of the neutral lipid, 25-40% of the sterol, and 0.5-10% of the PEG or PEG-modified lipid on a molar basis.

In some embodiments, lipid nanoparticle formulations include 60% of a cationic lipid selected from 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate (L319), 7.5% of the neutral lipid, 31% of the sterol, and 1.5% of the PEG or PEG-modified lipid on a molar basis.

In some embodiments, lipid nanoparticle formulations include 50% of a cationic lipid selected from 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate (L319), 10% of the neutral lipid, 38.5% of the sterol, and 1.5% of the PEG or PEG-modified lipid on a molar basis.

In some embodiments, lipid nanoparticle formulations include 50% of a cationic lipid selected from 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate (L319), 10% of the neutral lipid, 35% of the sterol, 4.5% or 5% of the PEG or PEG-modified lipid, and 0.5% of the targeting lipid on a molar basis.

In some embodiments, lipid nanoparticle formulations include 40% of a cationic lipid selected from 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate (L319), 15% of the neutral lipid, 40% of the sterol, and 5% of the PEG or PEG-modified lipid on a molar basis.

In some embodiments, lipid nanoparticle formulations include 57.2% of a cationic lipid selected from 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate (L319), 7.1% of the neutral lipid, 34.3% of the sterol, and 1.4% of the PEG or PEG-modified lipid on a molar basis.

In some embodiments, lipid nanoparticle formulations include 57.5% of a cationic lipid selected from the PEG lipid is PEG-cDMA (PEG-cDMA is further discussed in Reyes et al. (*J. Controlled Release*, 107, 276-287 (2005), the contents of which are herein incorporated by reference in their entirety), 7.5% of the neutral lipid, 31.5% of the sterol, and 3.5% of the PEG or PEG-modified lipid on a molar basis.

In some embodiments, lipid nanoparticle formulations consist essentially of a lipid mixture in molar ratios of 20-70% cationic lipid:5-45% neutral lipid:20-55% cholesterol:0.5-15% PEG-modified lipid. In some embodiments, lipid nanoparticle formulations consist essentially of a lipid mixture in a molar ratio of 20-60% cationic lipid:5-25% neutral lipid:25-55% cholesterol:0.5-15% PEG-modified lipid.

In some embodiments, the molar lipid ratio is 50/10/38.5/1.5 (mol % cationic lipid/neutral lipid, e.g., DSPC/Chol/PEG-modified lipid, e.g., PEG-DMG, PEG-DSG or PEG-DPG), 57.2/7.1134.3/1.4 (mol % cationic lipid/neutral lipid, e.g., DPPC/Chol/PEG-modified lipid, e.g., PEG-cDMA), 40/15/40/5 (mol % cationic lipid/neutral lipid, e.g., DSPC/Chol/PEG-modified lipid, e.g., PEG-DMG), 50/10/35/4.5/0.5 (mol % cationic lipid/neutral lipid, e.g., DSPC/Chol/PEG-modified lipid, e.g., PEG-DSG), 50/10/35/5 (cationic lipid/neutral lipid, e.g., DSPC/Chol/PEG-modified lipid, e.g., PEG-DMG), 40/10/40/10 (mol % cationic lipid/neutral lipid, e.g., DSPC/Chol/PEG-modified lipid, e.g., PEG-DMG or PEG-cDMA), 35/15/40/10 (mol % cationic lipid/neutral lipid, e.g., DSPC/Chol/PEG-modified lipid, e.g., PEG-DMG or PEG-cDMA) or 52/13/30/5 (mol % cationic lipid/neutral lipid, e.g., DSPC/Chol/PEG-modified lipid, e.g., PEG-DMG or PEG-cDMA).

Non-limiting examples of lipid nanoparticle compositions and methods of making them are described, for example, in Semple et al. (2010) *Nat. Biotechnol.* 28:172-176; Jayarama et al. (2012), *Angew. Chem. Int. Ed.*, 51: 8529-8533; and Maier et al. (2013) *Molecular Therapy* 21, 1570-1578 (the contents of each of which are incorporated herein by reference in their entirety).

In some embodiments, lipid nanoparticle formulations may comprise a cationic lipid, a PEG lipid and a structural lipid and optionally comprise a non-cationic lipid. As a non-limiting example, a lipid nanoparticle may comprise 40-60% of cationic lipid, 5-15% of a non-cationic lipid, 1-2% of a PEG lipid and 30-50% of a structural lipid. As another non-limiting example, the lipid nanoparticle may comprise 50% cationic lipid, 10% non-cationic lipid, 1.5% PEG lipid and 38.5% structural lipid. As yet another non-limiting example, a lipid nanoparticle may comprise 55% cationic lipid, 10% non-cationic lipid, 2.5% PEG lipid and 32.5% structural lipid. In some embodiments, the cationic lipid may be any cationic lipid described herein such as, but not limited to, DLin-KC2-DMA, DLin-MC3-DMA and L319.

In some embodiments, the lipid nanoparticle formulations described herein may be 4 component lipid nanoparticles. The lipid nanoparticle may comprise a cationic lipid, a non-cationic lipid, a PEG lipid and a structural lipid. As a non-limiting example, the lipid nanoparticle may comprise 40-60% of cationic lipid, 5-15% of a non-cationic lipid, 1-2% of a PEG lipid and 30-50% of a structural lipid. As another non-limiting example, the lipid nanoparticle may comprise 50% cationic lipid, 10% non-cationic lipid, 1.5% PEG lipid and 38.5% structural lipid. As yet another non-limiting example, the lipid nanoparticle may comprise 55% cationic lipid, 10% non-cationic lipid, 2.5% PEG lipid and 32.5% structural lipid. In some embodiments, the cationic lipid may be any cationic lipid described herein such as, but not limited to, DLin-KC2-DMA, DLin-MC3-DMA and L319.

In some embodiments, the lipid nanoparticle formulations described herein may comprise a cationic lipid, a non-cationic lipid, a PEG lipid and a structural lipid. As a non-limiting example, the lipid nanoparticle comprises 50% of the cationic lipid DLin-KC2-DMA, 10% of the non-cationic lipid DSPC, 1.5% of the PEG lipid PEG-DOMG and 38.5% of the structural lipid cholesterol. As a non-limiting example, the lipid nanoparticle comprises 50% of the cationic lipid DLin-MC3-DMA, 10% of the non-cationic lipid DSPC, 1.5% of the PEG lipid PEG-DOMG and 38.5% of the structural lipid cholesterol. As a non-limiting example, the lipid nanoparticle comprises 50% of the cationic lipid DLin-MC3-DMA, 10% of the non-cationic lipid DSPC, 1.5% of the PEG lipid PEG-DMG and 38.5% of the structural lipid cholesterol. As yet another non-limiting example, the lipid nanoparticle comprises 55% of the cationic lipid L319, 10% of the non-cationic lipid DSPC, 2.5% of the PEG lipid PEG-DMG and 32.5% of the structural lipid cholesterol.

Relative amounts of the active ingredient, the pharmaceutically acceptable excipient, and/or any additional ingredients in a vaccine composition may vary, depending upon the identity, size, and/or condition of the subject being treated and further depending upon the route by which the composition is to be administered. For example, the composition may comprise between 0.1% and 99% (w/w) of the active ingredient. By way of example, the composition may comprise between 0.1% and 100%, e.g., between 0.5% and 50%, between 1-30%, between 5-80%, at least 80% (w/w) active ingredient.

In some embodiments, the tropical disease RNA (e.g. mRNA) vaccine composition may comprise the polynucleotide described herein, formulated in a lipid nanoparticle comprising MC3, Cholesterol, DSPC and PEG2000-DMG, the buffer trisodium citrate, sucrose and water for injection. As a non-limiting example, the composition comprises: 2.0 mg/mL of drug substance, 21.8 mg/mL of MC3, 10.1 mg/mL of cholesterol, 5.4 mg/mL of DSPC, 2.7 mg/mL of PEG2000-DMG, 5.16 mg/mL of trisodium citrate, 71 mg/mL of sucrose and 1.0 mL of water for injection.

In some embodiments, a nanoparticle (e.g., a lipid nanoparticle) has a mean diameter of 10-500 nm, 20-400 nm, 30-300 nm, or 40-200 nm. In some embodiments, a nanoparticle (e.g., a lipid nanoparticle) has a mean diameter of 50-150 nm, 50-200 nm, 80-100 nm or 80-200 nm.

Liposomes, Lipoplexes, and Lipid Nanoparticles

The RNA (e.g., mRNA) vaccines of the disclosure can be formulated using one or more liposomes, lipoplexes, or lipid nanoparticles. In some embodiments, pharmaceutical compositions of RNA (e.g., mRNA) vaccines include liposomes. Liposomes are artificially-prepared vesicles which may primarily be composed of a lipid bilayer and may be used as a delivery vehicle for the administration of nutrients and pharmaceutical formulations. Liposomes can be of different sizes such as, but not limited to, a multilamellar vesicle (MLV) which may be hundreds of nanometers in diameter and may contain a series of concentric bilayers separated by narrow aqueous compartments, a small unicellular vesicle (SUV) which may be smaller than 50 nm in diameter, and a large unilamellar vesicle (LUV) which may be between 50 and 500 nm in diameter. Liposome design may include, but is not limited to, opsonins or ligands in order to improve the attachment of liposomes to unhealthy tissue or to activate events such as, but not limited to, endocytosis. Liposomes may contain a low or a high pH in order to improve the delivery of the pharmaceutical formulations.

The formation of liposomes may depend on the physicochemical characteristics such as, but not limited to, the pharmaceutical formulation entrapped and the liposomal ingredients, the nature of the medium in which the lipid vesicles are dispersed, the effective concentration of the entrapped substance and its potential toxicity, any additional processes involved during the application and/or delivery of the vesicles, the optimization size, polydispersity and the shelf-life of the vesicles for the intended application, and the batch-to-batch reproducibility and possibility of large-scale production of safe and efficient liposomal products.

In some embodiments, pharmaceutical compositions described herein may include, without limitation, liposomes such as those formed from 1,2-dioleyloxy-N,N-dimethylaminopropane (DODMA) liposomes, DiLa2 liposomes from Marina Biotech (Bothell, Wash.), 1,2-dilinoleyloxy-3-dimethylaminopropane (DLin-DMA), 2,2-dilinoleyl-4-(2-dimethylaminoethyl)-[1,3]-dioxolane (DLin-KC2-DMA), and MC3 (US20100324120; herein incorporated by reference in its entirety) and liposomes which may deliver small molecule drugs such as, but not limited to, DOXIL® from Janssen Biotech, Inc. (Horsham, Pa.).

In some embodiments, pharmaceutical compositions described herein may include, without limitation, liposomes such as those formed from the synthesis of stabilized plasmid-lipid particles (SPLP) or stabilized nucleic acid lipid particle (SNALP) that have been previously described and shown to be suitable for oligonucleotide delivery in vitro and in vivo (see Wheeler et al. Gene Therapy. 1999 6:271-281; Zhang et al. Gene Therapy. 1999 6:1438-1447; Jeffs et al. Pharm Res. 2005 22:362-372; Morrissey et al., Nat Biotechnol. 2005 2:1002-1007; Zimmermann et al., Nature. 2006 441:111-114; Heyes et al. J Contr Rel. 2005 107:276-287; Semple et al. Nature Biotech. 2010 28:172-176; Judge et al. J Clin Invest. 2009 119:661-673; deFougerolles Hum Gene Ther. 2008 19:125-132; U.S. Patent Publication No US20130122104; all of which are incorporated herein in their entireties). The original manufacture method by Wheeler et al. was a detergent dialysis method, which was later improved by Jeffs et al. and is referred to as the spontaneous vesicle formation method. The liposome formulations are composed of 3 to 4 lipid components in addition to the polynucleotide. As an example a liposome can contain, but is not limited to, 55% cholesterol, 20% disteroylphosphatidyl choline (DSPC), 10% PEG-S-DSG, and 15% 1,2-dioleyloxy-N,N-dimethylaminopropane (DODMA), as described by Jeffs et al. As another example, certain liposome formulations may contain, but are not limited to, 48% cholesterol, 20% DSPC, 2% PEG-c-DMA, and 30% cationic lipid, where the cationic lipid can be 1,2-distearloxy-N,N-dimethylaminopropane (DSDMA), DODMA, DLin-DMA, or 1,2-dilinolenyloxy-3-dimethylaminopropane (DLenDMA), as described by Heyes et al.

In some embodiments, liposome formulations may comprise from about 25.0% cholesterol to about 40.0% cholesterol, from about 30.0% cholesterol to about 45.0% cholesterol, from about 35.0% cholesterol to about 50.0% cholesterol and/or from about 48.5% cholesterol to about 60% cholesterol. In some embodiments, formulations may comprise a percentage of cholesterol selected from the group consisting of 28.5%, 31.5%, 33.5%, 36.5%, 37.0%, 38.5%, 39.0% and 43.5%. In some embodiments, formulations may comprise from about 5.0% to about 10.0% DSPC and/or from about 7.0% to about 15.0% DSPC.

In some embodiments, the RNA (e.g., mRNA) vaccine pharmaceutical compositions may be formulated in liposomes such as, but not limited to, DiLa2 liposomes (Marina Biotech, Bothell, Wash.), SMARTICLES® (Marina Biotech, Bothell, Wash.), neutral DOPC (1,2-dioleoyl-sn-glycero-3-phosphocholine) based liposomes (e.g., siRNA delivery for ovarian cancer (Landen et al. Cancer Biology & Therapy 2006 5(12)1708-1713); herein incorporated by reference in its entirety) and hyaluronan-coated liposomes (Quiet Therapeutics, Israel).

In some embodiments, the cationic lipid may be a low molecular weight cationic lipid such as those described in U.S. Patent Application No. 20130090372, the contents of which are herein incorporated by reference in their entirety.

In some embodiments, the RNA (e.g., mRNA) vaccines may be formulated in a lipid vesicle, which may have crosslinks between functionalized lipid bilayers.

In some embodiments, the RNA (e.g., mRNA) vaccines may be formulated in a lipid-polycation complex. The formation of the lipid-polycation complex may be accomplished by methods known in the art and/or as described in U.S. Pub. No. 20120178702, herein incorporated by reference in its entirety. As a non-limiting example, the polycation may include a cationic peptide or a polypeptide such as, but not limited to, polylysine, polyornithine and/or polyarginine. In some embodiments, the RNA (e.g., mRNA) vaccines may be formulated in a lipid-polycation complex, which may further include a non-cationic lipid such as, but not limited to, cholesterol or dioleoyl phosphatidylethanolamine (DOPE).

In some embodiments, the ratio of PEG in the lipid nanoparticle (LNP) formulations may be increased or decreased and/or the carbon chain length of the PEG lipid may be modified from C14 to C18 to alter the pharmacokinetics and/or biodistribution of the LNP formulations. As a non-limiting example, LNP formulations may contain from about 0.5% to about 3.0%, from about 1.0% to about 3.5%, from about 1.5% to about 4.0%, from about 2.0% to about 4.5%, from about 2.5% to about 5.0% and/or from about 3.0% to about 6.0% of the lipid molar ratio of PEG-c-DOMG (R-3-[(ω-methoxy-poly(ethyleneglycol)2000)carbamoyl)]-1,2-dimyristyloxypropyl-3-amine) (also referred to herein as PEG-DOMG) as compared to the cationic lipid, DSPC and cholesterol. In some embodiments, the PEG-c-DOMG may be replaced with a PEG lipid such as, but not limited to, PEG-DSG (1,2-Distearoyl-sn-glycerol, methoxypolyethylene glycol), PEG-DMG (1,2-Dimyristoyl-sn-glycerol) and/or PEG-DPG (1,2-Dipalmitoyl-sn-glycerol, methoxypolyethylene glycol). The cationic lipid may be selected from any lipid known in the art such as, but not limited to, DLin-MC3-DMA, DLin-DMA, C12-200 and DLin-KC2-DMA.

In some embodiments, the RNA (e.g., mRNA) vaccines may be formulated in a lipid nanoparticle.

In some embodiments, the RNA (e.g., mRNA) vaccine formulation comprising the polynucleotide is a nanoparticle which may comprise at least one lipid. The lipid may be selected from, but is not limited to, DLin-DMA, DLin-K-DMA, 98N12-5, C12-200, DLin-MC3-DMA, DLin-KC2-DMA, DODMA, PLGA, PEG, PEG-DMG, PEGylated lipids and amino alcohol lipids. In another aspect, the lipid may be a cationic lipid such as, but not limited to, DLin-DMA, DLin-D-DMA, DLin-MC3-DMA, DLin-KC2-DMA, DODMA and amino alcohol lipids. The amino alcohol cationic lipid may be the lipids described in and/or made by the methods described in U.S. Patent Publication No. US20130150625, herein incorporated by reference in its entirety. As a non-limiting example, the cationic lipid may be 2-amino-3-[(9Z,12Z)-octadeca-9,12-dien-1-yloxy]-2-{[(9Z,2Z)-octadeca-9,12-dien-1-yloxy]methyl}propan-1-ol (Compound 1 in US20130150625); 2-amino-3-[(9Z)-octadec-9-en-1-yloxy]-2-{[(9Z)-octadec-9-en-1-yloxy]methyl}propan-1-ol (Compound 2 in US20130150625); 2-amino-3-[(9Z,12Z)-octadeca-9,12-dien-1-yloxy]-2-[(octyloxy)methyl]propan-1-ol (Compound 3 in US20130150625); and 2-(dimethylamino)-3-[(9Z,12Z)-octadeca-9,12-dien-1-yloxy]-2-{[(9Z,12Z)-octadeca-9,12-dien-1-yloxy]methyl}propan-1-ol (Compound 4 in US20130150625); or any pharmaceutically acceptable salt or stereoisomer thereof.

Lipid nanoparticle formulations typically comprise a lipid, in particular, an ionizable cationic lipid, for example, 2,2-dilinoleyl-4-dimethylaminoethyl-[1,3]-dioxolane (DLin-KC2-DMA), dilinoleyl-methyl-4-dimethylaminobutyrate (DLin-MC3-DMA), or di((Z)-non-2-en-1-yl) 9-((4-(dimethylamino)butanoyl)oxy)heptadecanedioate (L319), and further comprise a neutral lipid, a sterol and a molecule capable of reducing particle aggregation, for example a PEG or PEG-modified lipid.

In some embodiments, the lipid nanoparticle formulation consists essentially of (i) at least one lipid selected from the group consisting of 2,2-dilinoleyl-4-dimethylaminoethyl-[1, 3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate (L319); (ii) a neutral lipid selected from DSPC, DPPC, POPC, DOPE and SM; (iii) a sterol, e.g., cholesterol; and (iv) a PEG-lipid, e.g., PEG-DMG or PEG-cDMA, in a molar ratio of about 20-60% cationic lipid:5-25% neutral lipid:25-55% sterol; 0.5-15% PEG-lipid.

In some embodiments, the formulation includes from about 25% to about 75% on a molar basis of a cationic lipid selected from 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate (L319), e.g., from about 35 to about 65%, from about 45 to about 65%, about 60%, about 57.5%, about 50% or about 40% on a molar basis.

In some embodiments, the formulation includes from about 0.5% to about 15% on a molar basis of the neutral lipid e.g., from about 3 to about 12%, from about 5 to about 10% or about 15%, about 10%, or about 7.5% on a molar basis. Examples of neutral lipids include, but are not limited to, DSPC, POPC, DPPC, DOPE and SM. In some embodiments, the formulation includes from about 5% to about 50% on a molar basis of the sterol (e.g., about 15 to about 45%, about 20 to about 40%, about 40%, about 38.5%, about 35%, or about 31% on a molar basis. An exemplary sterol is cholesterol. In some embodiments, the formulation includes from about 0.5% to about 20% on a molar basis of the PEG or PEG-modified lipid (e.g., about 0.5 to about 10%, about 0.5 to about 5%, about 1.5%, about 0.5%, about 1.5%, about 3.5%, or about 5% on a molar basis). In some embodiments, the PEG or PEG modified lipid comprises a PEG molecule of an average molecular weight of 2,000 Da. In other embodiments, the PEG or PEG modified lipid comprises a PEG molecule of an average molecular weight of less than 2,000, for example around 1,500 Da, around 1,000 Da, or around 500 Da. Examples of PEG-modified lipids include, but are not limited to, PEG-distearoyl glycerol (PEG-DMG) (also referred herein as PEG-C14 or C14-PEG), PEG-cDMA (further discussed in Reyes et al. *J. Controlled Release*, 107, 276-287 (2005) the contents of which are herein incorporated by reference in their entirety)

In some embodiments, the formulations of the present disclosure include 25-75% of a cationic lipid selected from 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate (L319), 0.5-15% of the neutral lipid, 5-50% of the sterol, and 0.5-20% of the PEG or PEG-modified lipid on a molar basis.

In some embodiments, the formulations of the present disclosure include 35-65% of a cationic lipid selected from 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate (L319), 3-12% of the neutral lipid, 15-45% of the sterol, and 0.5-10% of the PEG or PEG-modified lipid on a molar basis.

In some embodiments, the formulations of the present disclosure include 45-65% of a cationic lipid selected from 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate (L319), 5-10% of the neutral lipid, 25-40% of the sterol, and 0.5-10% of the PEG or PEG-modified lipid on a molar basis.

In some embodiments, the formulations of the present disclosure include about 60% of a cationic lipid selected from 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-

(dimethylamino)butanoyl)oxy)heptadecanedioate (L319), about 7.5% of the neutral lipid, about 31% of the sterol, and about 1.5% of the PEG or PEG-modified lipid on a molar basis.

In some embodiments, the formulations of the present disclosure include about 50% of a cationic lipid selected from 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate (L319), about 10% of the neutral lipid, about 38.5% of the sterol, and about 1.5% of the PEG or PEG-modified lipid on a molar basis.

In some embodiments, the formulations of the present disclosure include about 50% of a cationic lipid selected from 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate (L319), about 10% of the neutral lipid, about 35% of the sterol, about 4.5% or about 5% of the PEG or PEG-modified lipid, and about 0.5% of the targeting lipid on a molar basis.

In some embodiments, the formulations of the present disclosure include about 40% of a cationic lipid selected from 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate (L319), about 15% of the neutral lipid, about 40% of the sterol, and about 5% of the PEG or PEG-modified lipid on a molar basis.

In some embodiments, the formulations of the present disclosure include about 57.2% of a cationic lipid selected from 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate (L319), about 7.1% of the neutral lipid, about 34.3% of the sterol, and about 1.4% of the PEG or PEG-modified lipid on a molar basis.

In some embodiments, the formulations of the present disclosure include about 57.5% of a cationic lipid selected from the PEG lipid is PEG-cDMA (PEG-cDMA is further discussed in Reyes et al. (J. Controlled Release, 107, 276-287 (2005), the contents of which are herein incorporated by reference in their entirety), about 7.5% of the neutral lipid, about 31.5% of the sterol, and about 3.5% of the PEG or PEG-modified lipid on a molar basis.

In some embodiments, lipid nanoparticle formulation consists essentially of a lipid mixture in molar ratios of about 20-70% cationic lipid:5-45% neutral lipid:20-55% cholesterol:0.5-15% PEG-modified lipid; more preferably in a molar ratio of about 20-60% cationic lipid:5-25% neutral lipid:25-55% cholesterol:0.5-15% PEG-modified lipid.

In some embodiments, the molar lipid ratio is approximately 50/10/38.5/1.5 (mol % cationic lipid/neutral lipid, e.g., DSPC/Chol/PEG-modified lipid, e.g., PEG-DMG, PEG-DSG or PEG-DPG), 57.2/7.1134.3/1.4 (mol % cationic lipid/neutral lipid, e.g., DPPC/Chol/PEG-modified lipid, e.g., PEG-cDMA), 40/15/40/5 (mol % cationic lipid/neutral lipid, e.g., DSPC/Chol/PEG-modified lipid, e.g., PEG-DMG), 50/10/35/4.5/0.5 (mol % cationic lipid/neutral lipid, e.g., DSPC/Chol/PEG-modified lipid, e.g., PEG-DSG), 50/10/35/5 (cationic lipid/neutral lipid, e.g., DSPC/Chol/PEG-modified lipid, e.g., PEG-DMG), 40/10/40/10 (mol % cationic lipid/neutral lipid, e.g., DSPC/Chol/PEG-modified lipid, e.g., PEG-DMG or PEG-cDMA), 35/15/40/10 (mol % cationic lipid/neutral lipid, e.g., DSPC/Chol/PEG-modified lipid, e.g., PEG-DMG or PEG-cDMA) or 52/13/30/5 (mol % cationic lipid/neutral lipid, e.g., DSPC/Chol/PEG-modified lipid, e.g., PEG-DMG or PEG-cDMA).

Examples of lipid nanoparticle compositions and methods of making same are described, for example, in Semple et al. (2010) *Nat. Biotechnol.* 28:172-176; Jayarama et al. (2012), *Angew. Chem. Int. Ed.*, 51: 8529-8533; and Maier et al. (2013) *Molecular Therapy* 21, 1570-1578 (the contents of each of which are incorporated herein by reference in their entirety).

In some embodiments, the LNP formulations of the RNA (e.g., mRNA) vaccines may contain PEG-c-DOMG at 3% lipid molar ratio. In some embodiments, the LNP formulations of the RNA (e.g., mRNA) vaccines may contain PEG-c-DOMG at 1.5% lipid molar ratio.

In some embodiments, the pharmaceutical compositions of the RNA (e.g., mRNA) vaccines may include at least one of the PEGylated lipids described in International Publication No. WO2012099755, the contents of which are herein incorporated by reference in their entirety.

In some embodiments, the LNP formulation may contain PEG-DMG 2000 (1,2-dimyristoyl-sn-glycero-3-phophoethanolamine-N-[methoxy(polyethylene glycol)-2000). In some embodiments, the LNP formulation may contain PEG-DMG 2000, a cationic lipid known in the art and at least one other component. In some embodiments, the LNP formulation may contain PEG-DMG 2000, a cationic lipid known in the art, DSPC and cholesterol. As a non-limiting example, the LNP formulation may contain PEG-DMG 2000, DLin-DMA, DSPC and cholesterol. As another non-limiting example the LNP formulation may contain PEG-DMG 2000, DLin-DMA, DSPC and cholesterol in a molar ratio of 2:40:10:48 (see e.g., Geall et al., Nonviral delivery of self-amplifying RNA (e.g., mRNA) vaccines, PNAS 2012; PMID: 22908294, the contents of each of which are herein incorporated by reference in their entirety).

The lipid nanoparticles described herein may be made in a sterile environment.

In some embodiments, the LNP formulation may be formulated in a nanoparticle such as a nucleic acid-lipid particle. As a non-limiting example, the lipid particle may comprise one or more active agents or therapeutic agents; one or more cationic lipids comprising from about 50 mol % to about 85 mol % of the total lipid present in the particle; one or more non-cationic lipids comprising from about 13 mol % to about 49.5 mol % of the total lipid present in the particle; and one or more conjugated lipids that inhibit aggregation of particles comprising from about 0.5 mol % to about 2 mol % of the total lipid present in the particle.

The nanoparticle formulations may comprise a phosphate conjugate. The phosphate conjugate may increase in vivo circulation times and/or increase the targeted delivery of the nanoparticle. As a non-limiting example, the phosphate conjugates may include a compound of any one of the formulas described in International Application No. WO2013033438, the contents of which are herein incorporated by reference in its entirety.

The nanoparticle formulation may comprise a polymer conjugate. The polymer conjugate may be a water-soluble conjugate. The polymer conjugate may have a structure as described in U.S. Patent Application No. 20130059360, the contents of which are herein incorporated by reference in its entirety. In some embodiments, polymer conjugates with the polynucleotides of the present disclosure may be made using the methods and/or segmented polymeric reagents described in U.S. Patent Application No. 20130072709, the contents of which are herein incorporated by reference in its entirety. In some embodiments, the polymer conjugate may have pendant side groups comprising ring moieties such as, but not limited to, the polymer conjugates described in U.S. Patent Publication No. US20130196948, the contents which are herein incorporated by reference in its entirety.

The nanoparticle formulations may comprise a conjugate to enhance the delivery of nanoparticles of the present disclosure in a subject. Further, the conjugate may inhibit phagocytic clearance of the nanoparticles in a subject. In one aspect, the conjugate may be a "self" peptide designed from the human membrane protein CD47 (e.g., the "self" particles described by Rodriguez et al. (Science 2013 339, 971-975), herein incorporated by reference in its entirety). As shown by Rodriguez et al., the self peptides delayed macrophage-mediated clearance of nanoparticles which enhanced delivery of the nanoparticles. In another aspect, the conjugate may be the membrane protein CD47 (e.g., see Rodriguez et al. Science 2013 339, 971-975, herein incorporated by reference in its entirety). Rodriguez et al. showed that, similarly to "self" peptides, CD47 can increase the circulating particle ratio in a subject as compared to scrambled peptides and PEG coated nanoparticles.

In some embodiments, the RNA (e.g., mRNA) vaccines of the present disclosure are formulated in nanoparticles which comprise a conjugate to enhance the delivery of the nanoparticles of the present disclosure in a subject. The conjugate may be the CD47 membrane or the conjugate may be derived from the CD47 membrane protein, such as the "self" peptide described previously. In some embodiments, the nanoparticle may comprise PEG and a conjugate of CD47 or a derivative thereof. In some embodiments, the nanoparticle may comprise both the "self" peptide described above and the membrane protein CD47.

In some embodiments, a "self" peptide and/or CD47 protein may be conjugated to a virus-like particle or pseudovirion, as described herein for delivery of the RNA (e.g., mRNA) vaccines of the present disclosure.

In some embodiments, RNA (e.g., mRNA) vaccine pharmaceutical compositions comprising the polynucleotides of the present disclosure and a conjugate that may have a degradable linkage. Non-limiting examples of conjugates include an aromatic moiety comprising an ionizable hydrogen atom, a spacer moiety, and a water-soluble polymer. As a non-limiting example, pharmaceutical compositions comprising a conjugate with a degradable linkage and methods for delivering such pharmaceutical compositions are described in U.S. Patent Publication No. US20130184443, the contents of which are herein incorporated by reference in their entirety.

The nanoparticle formulations may be a carbohydrate nanoparticle comprising a carbohydrate carrier and a RNA (e.g., mRNA) vaccine. As a non-limiting example, the carbohydrate carrier may include, but is not limited to, an anhydride-modified phytoglycogen or glycogen-type material, phytoglycogen octenyl succinate, phytoglycogen beta-dextrin, anhydride-modified phytoglycogen beta-dextrin. (See e.g., International Publication No. WO2012109121; the contents of which are herein incorporated by reference in their entirety).

Nanoparticle formulations of the present disclosure may be coated with a surfactant or polymer in order to improve the delivery of the particle. In some embodiments, the nanoparticle may be coated with a hydrophilic coating such as, but not limited to, PEG coatings and/or coatings that have a neutral surface charge. The hydrophilic coatings may help to deliver nanoparticles with larger payloads such as, but not limited to, RNA (e.g., mRNA) vaccines within the central nervous system. As a non-limiting example nanoparticles comprising a hydrophilic coating and methods of making such nanoparticles are described in U.S. Patent Publication No. US20130183244, the contents of which are herein incorporated by reference in their entirety.

In some embodiments, the lipid nanoparticles of the present disclosure may be hydrophilic polymer particles. Non-limiting examples of hydrophilic polymer particles and methods of making hydrophilic polymer particles are described in U.S. Patent Publication No. US20130210991, the contents of which are herein incorporated by reference in their entirety.

In some embodiments, the lipid nanoparticles of the present disclosure may be hydrophobic polymer particles.

Lipid nanoparticle formulations may be improved by replacing the cationic lipid with a biodegradable cationic lipid which is known as a rapidly eliminated lipid nanoparticle (reLNP). Ionizable cationic lipids, such as, but not limited to, DLinDMA, DLin-KC2-DMA, and DLin-MC3-DMA, have been shown to accumulate in plasma and tissues over time and may be a potential source of toxicity. The rapid metabolism of the rapidly eliminated lipids can improve the tolerability and therapeutic index of the lipid nanoparticles by an order of magnitude from a 1 mg/kg dose to a 10 mg/kg dose in rat. Inclusion of an enzymatically degraded ester linkage can improve the degradation and metabolism profile of the cationic component, while still maintaining the activity of the reLNP formulation. The ester linkage can be internally located within the lipid chain or it may be terminally located at the terminal end of the lipid chain. The internal ester linkage may replace any carbon in the lipid chain.

In some embodiments, the internal ester linkage may be located on either side of the saturated carbon.

In some embodiments, an immune response may be elicited by delivering a lipid nanoparticle which may include a nanospecies, a polymer and an immunogen. (U.S. Publication No. 20120189700 and International Publication No. WO2012099805; each of which is herein incorporated by reference in their entirety). The polymer may encapsulate the nanospecies or partially encapsulate the nanospecies. The immunogen may be a recombinant protein, a modified RNA and/or a polynucleotide described herein. In some embodiments, the lipid nanoparticle may be formulated for use in a vaccine such as, but not limited to, against a pathogen.

Lipid nanoparticles may be engineered to alter the surface properties of particles so the lipid nanoparticles may penetrate the mucosal barrier. Mucus is located on mucosal tissue such as, but not limited to, oral (e.g., the buccal and esophageal membranes and tonsil tissue), ophthalmic, gastrointestinal (e.g., stomach, small intestine, large intestine, colon, rectum), nasal, respiratory (e.g., nasal, pharyngeal, tracheal and bronchial membranes), genital (e.g., vaginal, cervical and urethral membranes). Nanoparticles larger than 10-200 nm which are preferred for higher drug encapsulation efficiency and the ability to provide the sustained delivery of a wide array of drugs have been thought to be too large to rapidly diffuse through mucosal barriers. Mucus is continuously secreted, shed, discarded or digested and recycled so most of the trapped particles may be removed from the mucosa tissue within seconds or within a few hours. Large polymeric nanoparticles (200 nm-500 nm in diameter) which have been coated densely with a low molecular weight polyethylene glycol (PEG) diffused through mucus only 4- to 6-fold lower than the same particles diffusing in water (Lai et al. PNAS 2007 104:1482-487; Lai et al. *Adv Drug Deliv Rev.* 2009 61: 158-171; each of which is herein incorporated by reference in its entirety). The transport of nanoparticles may be determined using rates of permeation and/or fluorescent microscopy techniques including, but not limited to, fluorescence recovery after photobleaching (FRAP) and high resolution multiple particle tracking (MPT). As a non-limiting example, compositions which can penetrate a mucosal barrier may be made as described in U.S. Pat. No. 8,241,670 or International Patent Publication No. WO2013110028, the contents of each of which are herein incorporated by reference in its entirety.

The lipid nanoparticle engineered to penetrate mucus may comprise a polymeric material (i.e. a polymeric core) and/or a polymer-vitamin conjugate and/or a tri-block co-polymer. The polymeric material may include, but is not limited to, polyamines, polyethers, polyamides, polyesters, polycarbamates, polyureas, polycarbonates, poly(styrenes), polyimides, polysulfones, polyurethanes, polyacetylenes, polyethylenes, polyethyeneimines, polyisocyanates, polyacrylates, polymethacrylates, polyacrylonitriles, and polyarylates. The polymeric material may be biodegradable and/or biocompatible. Non-limiting examples of biocompatible polymers are described in International Patent Publication No. WO2013116804, the contents of which are herein incorporated by reference in their entirety. The polymeric material may additionally be irradiated. As a non-limiting example, the polymeric material may be gamma irradiated (see e.g., International App. No. WO201282165, herein incorporated by reference in its entirety). Non-limiting examples of specific polymers include poly(caprolactone) (PCL), ethylene vinyl acetate polymer (EVA), poly(lactic acid) (PLA), poly(L-lactic acid) (PLLA), poly(glycolic acid) (PGA), poly(lactic acid-co-glycolic acid) (PLGA), poly(L-lactic acid-co-glycolic acid) (PLLGA), poly(D,L-lactide) (PDLA), poly(L-lactide) (PLLA), poly(D,L-lactide-co-caprolactone), poly(D,L-lactide-co-caprolactone-co-glycolide), poly(D,L-lactide-co-PEO-co-D,L-lactide), poly(D,L-lactide-co-PPO-co-D,L-lactide), polyalkyl cyanoacralate, polyurethane, poly-L-lysine (PLL), hydroxypropyl methacrylate (HPMA), polyethyleneglycol, poly-L-glutamic acid, poly(hydroxy acids), polyanhydrides, polyorthoesters, poly(ester amides), polyamides, poly(ester ethers), polycarbonates, polyalkylenes such as polyethylene and polypropylene, polyalkylene glycols such as poly(ethylene glycol) (PEG), polyalkylene oxides (PEO), polyalkylene terephthalates such as poly(ethylene terephthalate), polyvinyl alcohols (PVA), polyvinyl ethers, polyvinyl esters such as poly(vinyl acetate), polyvinyl halides such as poly(vinyl chloride) (PVC), polyvinylpyrrolidone, polysiloxanes, polystyrene (PS), polyurethanes, derivatized celluloses such as alkyl celluloses, hydroxyalkyl celluloses, cellulose ethers, cellulose esters, nitro celluloses, hydroxypropylcellulose, carboxymethylcellulose, polymers of acrylic acids, such as poly(methyl(meth)acrylate) (PMMA), poly(ethyl(meth)acrylate), poly(butyl(meth)acrylate), poly(isobutyl(meth)acrylate), poly(hexyl(meth)acrylate), poly(isodecyl(meth)acrylate), poly(lauryl(meth)acrylate), poly(phenyl(meth)acrylate), poly(methyl acrylate), poly(isopropyl acrylate), poly(isobutyl acrylate), poly(octadecyl acrylate) and copolymers and mixtures thereof, polydioxanone and its copolymers, polyhydroxyalkanoates, polypropylene fumarate, polyoxymethylene, poloxamers, poly(ortho)esters, poly(butyric acid), poly(valeric acid), poly(lactide-co-caprolactone), PEG-PLGA-PEG and trimethylene carbonate, polyvinylpyrrolidone. The lipid nanoparticle may be coated or associated with a co-polymer such as, but not limited to, a block co-polymer (such as a branched polyether-polyamide block copolymer described in International Publication No. WO2013012476, herein incorporated by reference in its entirety), and (poly(ethylene glycol))-(poly(propylene oxide))-(poly(ethylene glycol)) tri-block copolymer (see e.g., U.S. Publication 20120121718 and U.S. Publication 20100003337 and U.S. Pat. No. 8,263,665, the contents of each of which is herein incorporated by reference in their entirety). The co-polymer may be a polymer that is generally regarded as safe (GRAS) and the formation of the lipid nanoparticle may be in such a way that no new chemical entities are created. For example, the lipid nanoparticle may comprise poloxamers coating PLGA nanoparticles without forming new chemical entities which are still able to rapidly penetrate human mucus (Yang et al. Angew. Chem. Int. Ed. 2011 50:2597-2600; the contents of which are herein incorporated by reference in their entirety). A non-limiting scalable method to produce nanoparticles which can penetrate human mucus is described by Xu et al. (see, e.g., J Control Release 2013, 170:279-86; the contents of which are herein incorporated by reference in their entirety).

The vitamin of the polymer-vitamin conjugate may be vitamin E. The vitamin portion of the conjugate may be substituted with other suitable components such as, but not limited to, vitamin A, vitamin E, other vitamins, cholesterol, a hydrophobic moiety, or a hydrophobic component of other surfactants (e.g., sterol chains, fatty acids, hydrocarbon chains and alkylene oxide chains).

The lipid nanoparticle engineered to penetrate mucus may include surface altering agents such as, but not limited to, polynucleotides, anionic proteins (e.g., bovine serum albumin), surfactants (e.g., cationic surfactants such as for example dimethyldioctadecylammonium bromide), sugars or sugar derivatives (e.g., cyclodextrin), nucleic acids, polymers (e.g., heparin, polyethylene glycol and poloxamer), mucolytic agents (e.g., N-acetylcysteine, mugwort, bromelain, papain, clerodendrum, acetylcysteine, bromhexine, carbocisteine, eprazinone, mesna, ambroxol, sobrerol, domiodol, letosteine, stepronin, tiopronin, gelsolin, thymosin β4 dornase alfa, neltenexine, erdosteine) and various DNases including rhDNase. The surface altering agent may be embedded or enmeshed in the particle's surface or disposed (e.g., by coating, adsorption, covalent linkage, or other process) on the surface of the lipid nanoparticle. (see e.g., U.S. Publication 20100215580 and U.S. Publication 20080166414 and US20130164343; the contents of each of which are herein incorporated by reference in their entirety).

In some embodiments, the mucus penetrating lipid nanoparticles may comprise at least one polynucleotide described herein. The polynucleotide may be encapsulated in the lipid nanoparticle and/or disposed on the surface of the particle. The polynucleotide may be covalently coupled to the lipid nanoparticle. Formulations of mucus penetrating lipid nanoparticles may comprise a plurality of nanoparticles. Further, the formulations may contain particles which may interact with the mucus and alter the structural and/or adhesive properties of the surrounding mucus to decrease mucoadhesion, which may increase the delivery of the mucus penetrating lipid nanoparticles to the mucosal tissue.

In some embodiments, the mucus penetrating lipid nanoparticles may be a hypotonic formulation comprising a mucosal penetration enhancing coating. The formulation may be hypotonic for the epithelium to which it is being delivered. Non-limiting examples of hypotonic formulations may be found in International Patent Publication No.

WO2013110028, the contents of which are herein incorporated by reference in their entirety.

In some embodiments, in order to enhance the delivery through the mucosal barrier the RNA (e.g., mRNA) vaccine formulation may comprise or be a hypotonic solution. Hypotonic solutions were found to increase the rate at which mucoinert particles such as, but not limited to, mucus-penetrating particles, were able to reach the vaginal epithelial surface (see e.g., Ensign et al. Biomaterials 2013 34(28): 6922-9, the contents of which are herein incorporated by reference in their entirety).

In some embodiments, the RNA (e.g., mRNA) vaccine is formulated as a lipoplex, such as, without limitation, the ATUPLEX™® system, the DACC system, the DBTC system and other siRNA-lipoplex technology from Silence Therapeutics (London, United Kingdom), STEMFECT™ from STEMGENT® (Cambridge, Mass.), and polyethylenimine (PEI) or protamine-based targeted and non-targeted delivery of nucleic acids (Aleku et al. Cancer Res. 2008 68:9788-9798; Strumberg et al. Int J Clin Pharmacol Ther 2012 50:76-78; Santel et al., Gene Ther 2006 13:1222-1234; Santel et al., Gene Ther 2006 13:1360-1370; Gutbier et al., Pulm Pharmacol. Ther. 2010 23:334-344; Kaufmann et al. Microvasc Res 2010 80:286-293Weide et al. J Immunother. 2009 32:498-507; Weide et al. J Immunother. 2008 31:180-188; Pascolo Expert Opin. Biol. Ther. 4:1285-1294; Fotin-Mleczek et al., 2011 J. Immunother. 34:1-15; Song et al., Nature Biotechnol. 2005, 23:709-717; Peer et al., Proc Natl Acad Sci USA. 2007 6; 104:4095-4100; deFougerolles Hum Gene Ther. 2008 19:125-132, the contents of each of which are incorporated herein by reference in their entirety).

In some embodiments, such formulations may also be constructed or compositions altered such that they passively or actively are directed to different cell types in vivo, including but not limited to hepatocytes, immune cells, tumor cells, endothelial cells, antigen presenting cells, and leukocytes (Akinc et al. Mol Ther. 2010 18:1357-1364; Song et al., Nat Biotechnol. 2005 23:709-717; Judge et al., J Clin Invest. 2009 119:661-673; Kaufmann et al., Microvasc Res 2010 80:286-293; Santel et al., Gene Ther 2006 13:1222-1234; Santel et al., Gene Ther 2006 13:1360-1370; Gutbier et al., Pulm Pharmacol. Ther. 2010 23:334-344; Basha et al., Mol. Ther. 2011 19:2186-2200; Fenske and Cullis, Expert Opin Drug Deliv. 2008 5:25-44; Peer et al., Science. 2008 319:627-630; Peer and Lieberman, Gene Ther. 2011 18:1127-1133, the contents of each of which are incorporated herein by reference in their entirety). One example of passive targeting of formulations to liver cells includes the DLin-DMA, DLin-KC2-DMA and DLin-MC3-DMA-based lipid nanoparticle formulations, which have been shown to bind to apolipoprotein E and promote binding and uptake of these formulations into hepatocytes in vivo (Akinc et al. Mol Ther. 2010 18:1357-1364, the contents of which are incorporated herein by reference in their entirety). Formulations can also be selectively targeted through expression of different ligands on their surface as exemplified by, but not limited by, folate, transferrin, N-acetylgalactosamine (GalNAc), and antibody targeted approaches (Kolhatkar et al., Curr Drug Discov Technol. 2011 8:197-206; Musacchio and Torchilin, Front Biosci. 2011 16:1388-1412; Yu et al., Mol Membr Biol. 2010 27:286-298; Patil et al., Crit Rev Ther Drug Carrier Syst. 2008 25:1-61; Benoit et al., Biomacromolecules. 2011 12:2708-2714; Zhao et al., Expert Opin Drug Deliv. 2008 5:309-319; Akinc et al., Mol Ther. 2010 18:1357-1364; Srinivasan et al., Methods Mol Biol. 2012 820:105-116; Ben-Arie et al., Methods Mol Biol. 2012 757:497-507; Peer 2010 J Control Release. 20:63-68; Peer et al., Proc Natl Acad Sci USA. 2007 104:4095-4100; Kim et al., Methods Mol Biol. 2011 721:339-353; Subramanya et al., Mol Ther. 2010 18:2028-2037; Song et al., Nat Biotechnol. 2005 23:709-717; Peer et al., Science. 2008 319:627-630; Peer and Lieberman, Gene Ther. 2011 18:1127-1133, the contents of each of which are incorporated herein by reference in their entirety).

In some embodiments, the RNA (e.g., mRNA) vaccine is formulated as a solid lipid nanoparticle. A solid lipid nanoparticle (SLN) may be spherical with an average diameter between 10 to 1000 nm. SLNs possess a solid lipid core matrix that can solubilize lipophilic molecules and may be stabilized with surfactants and/or emulsifiers. In some embodiments, the lipid nanoparticle may be a self-assembly lipid-polymer nanoparticle (see Zhang et al., ACS Nano, 2008, 2, pp 1696-1702; the contents of which are herein incorporated by reference in their entirety). As a non-limiting example, the SLN may be the SLN described in International Patent Publication No. WO2013105101, the contents of which are herein incorporated by reference in their entirety. As another non-limiting example, the SLN may be made by the methods or processes described in International Patent Publication No. WO2013105101, the contents of which are herein incorporated by reference in their entirety.

Liposomes, lipoplexes, or lipid nanoparticles may be used to improve the efficacy of polynucleotides directed protein production as these formulations may be able to increase cell transfection by the RNA (e.g., mRNA) vaccine; and/or increase the translation of encoded protein. One such example involves the use of lipid encapsulation to enable the effective systemic delivery of polyplex plasmid DNA (Heyes et al., Mol Ther. 2007 15:713-720; the contents of which are incorporated herein by reference in their entirety). The liposomes, lipoplexes, or lipid nanoparticles may also be used to increase the stability of the polynucleotide.

In some embodiments, the RNA (e.g., mRNA) vaccines of the present disclosure can be formulated for controlled release and/or targeted delivery. As used herein, "controlled release" refers to a pharmaceutical composition or compound release profile that conforms to a particular pattern of release to effect a therapeutic outcome. In some embodiments, the RNA (e.g., mRNA) vaccines may be encapsulated into a delivery agent described herein and/or known in the art for controlled release and/or targeted delivery. As used herein, the term "encapsulate" means to enclose, surround or encase. As it relates to the formulation of the compounds of the disclosure, encapsulation may be substantial, complete or partial. The term "substantially encapsulated" means that at least greater than 50, 60, 70, 80, 85, 90, 95, 96, 97, 98, 99, 99.9, 99.99 or greater than 99.999% of the pharmaceutical composition or compound of the disclosure may be enclosed, surrounded or encased within the delivery agent. "Partially encapsulation" means that less than 10, 10, 20, 30, 40, 50% or less of the pharmaceutical composition or compound of the disclosure may be enclosed, surrounded or encased within the delivery agent. Advantageously, encapsulation may be determined by measuring the escape or the activity of the pharmaceutical composition or compound of the disclosure using fluorescence and/or electron micrograph. For example, at least 1, 5, 10, 20, 30, 40, 50, 60, 70, 80, 85, 90, 95, 96, 97, 98, 99, 99.9, 99.99 or greater than 99.999% of the pharmaceutical composition or compound of the disclosure are encapsulated in the delivery agent.

In some embodiments, the controlled release formulation may include, but is not limited to, tri-block co-polymers. As a non-limiting example, the formulation may include two different types of tri-block co-polymers (International Pub. No. WO2012131104 and WO2012131106, the contents of each of which are incorporated herein by reference in their entirety).

In some embodiments, the RNA (e.g., mRNA) vaccines may be encapsulated into a lipid nanoparticle or a rapidly eliminated lipid nanoparticle and the lipid nanoparticles or a rapidly eliminated lipid nanoparticle may then be encapsulated into a polymer, hydrogel and/or surgical sealant described herein and/or known in the art. As a non-limiting example, the polymer, hydrogel or surgical sealant may be PLGA, ethylene vinyl acetate (EVAc), poloxamer, GELSITE® (Nanotherapeutics, Inc. Alachua, Fla.), HYLENEX® (Halozyme Therapeutics, San Diego Calif.), surgical sealants such as fibrinogen polymers (Ethicon Inc. Cornelia, Ga.), TISSELL® (Baxter International, Inc Deerfield, Ill.), PEG-based sealants, and COSEAL® (Baxter International, Inc Deerfield, Ill.).

In some embodiments, the lipid nanoparticle may be encapsulated into any polymer known in the art which may form a gel when injected into a subject. As another non-limiting example, the lipid nanoparticle may be encapsulated into a polymer matrix which may be biodegradable.

In some embodiments, the RNA (e.g., mRNA) vaccine formulation for controlled release and/or targeted delivery may also include at least one controlled release coating. Controlled release coatings include, but are not limited to, OPADRY®, polyvinylpyrrolidone/vinyl acetate copolymer, polyvinylpyrrolidone, hydroxypropyl methylcellulose, hydroxypropyl cellulose, hydroxyethyl cellulose, EUDRAGIT RL®, EUDRAGIT RS® and cellulose derivatives such as ethylcellulose aqueous dispersions (AQUACOAT® and SURELEASE®).

In some embodiments, the RNA (e.g., mRNA) vaccine controlled release and/or targeted delivery formulation may comprise at least one degradable polyester which may contain polycationic side chains. Degradeable polyesters include, but are not limited to, poly(serine ester), poly(L-lactide-co-L-lysine), poly(4-hydroxy-L-proline ester), and combinations thereof. In some embodiments, the degradable polyesters may include a PEG conjugation to form a PEGylated polymer.

In some embodiments, the RNA (e.g., mRNA) vaccine controlled release and/or targeted delivery formulation comprising at least one polynucleotide may comprise at least one PEG and/or PEG related polymer derivatives as described in U.S. Pat. No. 8,404,222, the contents of which are incorporated herein by reference in their entirety.

In some embodiments, the RNA (e.g., mRNA) vaccine controlled release delivery formulation comprising at least one polynucleotide may be the controlled release polymer system described in US20130130348, the contents of which are incorporated herein by reference in their entirety.

In some embodiments, the RNA (e.g., mRNA) vaccines of the present disclosure may be encapsulated in a therapeutic nanoparticle, referred to herein as "therapeutic nanoparticle RNA (e.g., mRNA) vaccines." Therapeutic nanoparticles may be formulated by methods described herein and known in the art such as, but not limited to, International Pub Nos. WO2010005740, WO2010030763, WO2010005721, WO2010005723, WO2012054923, U.S. Publication Nos. US20110262491, US20100104645, US20100087337, US20100068285, US20110274759, US20100068286, US20120288541, US20130123351 and US20130230567 and U.S. Pat. Nos. 8,206,747, 8,293,276, 8,318,208 and 8,318,211; the contents of each of which are herein incorporated by reference in their entirety. In some embodiments, therapeutic polymer nanoparticles may be identified by the methods described in US Pub No. US20120140790, the contents of which are herein incorporated by reference in their entirety.

In some embodiments, the therapeutic nanoparticle RNA (e.g., mRNA) vaccine may be formulated for sustained release. As used herein, "sustained release" refers to a pharmaceutical composition or compound that conforms to a release rate over a specific period of time. The period of time may include, but is not limited to, hours, days, weeks, months and years. As a non-limiting example, the sustained release nanoparticle may comprise a polymer and a therapeutic agent such as, but not limited to, the polynucleotides of the present disclosure (see International Pub No. 2010075072 and US Pub No. US20100216804, US20110217377 and US20120201859, the contents of each of which are incorporated herein by reference in their entirety). In another non-limiting example, the sustained release formulation may comprise agents which permit persistent bioavailability such as, but not limited to, crystals, macromolecular gels and/or particulate suspensions (see U.S. Patent Publication No. US20130150295, the contents of each of which are incorporated herein by reference in their entirety).

In some embodiments, the therapeutic nanoparticle RNA (e.g., mRNA) vaccines may be formulated to be target specific. As a non-limiting example, the therapeutic nanoparticles may include a corticosteroid (see International Pub. No. WO2011084518, the contents of which are incorporated herein by reference in their entirety). As a non-limiting example, the therapeutic nanoparticles may be formulated in nanoparticles described in International Pub No. WO2008121949, WO2010005726, WO2010005725, WO2011084521 and US Pub No. US20100069426, US20120004293 and US20100104655, the contents of each of which are incorporated herein by reference in their entirety.

In some embodiments, the nanoparticles of the present disclosure may comprise a polymeric matrix. As a non-limiting example, the nanoparticle may comprise two or more polymers such as, but not limited to, polyethylenes, polycarbonates, polyanhydrides, polyhydroxyacids, polypropylfumerates, polycaprolactones, polyamides, polyacetals, polyethers, polyesters, poly(orthoesters), polycyanoacrylates, polyvinyl alcohols, polyurethanes, polyphosphazenes, polyacrylates, polymethacrylates, polycyanoacrylates, polyureas, polystyrenes, polyamines, polylysine, poly(ethylene imine), poly(serine ester), poly(L-lactide-co-L-lysine), poly(4-hydroxy-L-proline ester) or combinations thereof.

In some embodiments, the therapeutic nanoparticle comprises a diblock copolymer. In some embodiments, the diblock copolymer may include PEG in combination with a polymer such as, but not limited to, polyethylenes, polycarbonates, polyanhydrides, polyhydroxyacids, polypropylfumerates, polycaprolactones, polyamides, polyacetals, polyethers, polyesters, poly(orthoesters), polycyanoacrylates, polyvinyl alcohols, polyurethanes, polyphosphazenes, polyacrylates, polymethacrylates, polycyanoacrylates, polyureas, polystyrenes, polyamines, polylysine, poly(ethylene imine), poly(serine ester), poly(L-lactide-co-L-lysine), poly(4-hydroxy-L-proline ester) or combinations thereof. In yet another embodiment, the diblock copolymer may be a high-X diblock copolymer such as those described in International Patent Publication No. WO2013120052, the contents of which are incorporated herein by reference in their entirety.

As a non-limiting example the therapeutic nanoparticle comprises a PLGA-PEG block copolymer (see U.S. Publication No. US20120004293 and U.S. Pat. No. 8,236,330, each of which is herein incorporated by reference in their entirety). In another non-limiting example, the therapeutic nanoparticle is a stealth nanoparticle comprising a diblock copolymer of PEG and PLA or PEG and PLGA (see U.S. Pat. No. 8,246,968 and International Publication No. WO2012166923, the contents of each of which are herein incorporated by reference in their entirety). In yet another non-limiting example, the therapeutic nanoparticle is a stealth nanoparticle or a target-specific stealth nanoparticle as described in U.S. Patent Publication No. US20130172406, the contents of which are herein incorporated by reference in their entirety.

In some embodiments, the therapeutic nanoparticle may comprise a multiblock copolymer (see e.g., U.S. Pat. Nos. 8,263,665 and 8,287,910 and U.S. Patent Pub. No. US20130195987, the contents of each of which are herein incorporated by reference in their entirety).

In yet another non-limiting example, the lipid nanoparticle comprises the block copolymer PEG-PLGA-PEG (see e.g., the thermosensitive hydrogel (PEG-PLGA-PEG) was used as a TGF-beta1 gene delivery vehicle in Lee et al. Thermosensitive Hydrogel as a TGF-β1 Gene Delivery Vehicle Enhances Diabetic Wound Healing. Pharmaceutical Research, 2003 20(12): 1995-2000; as a controlled gene delivery system in Li et al. Controlled Gene Delivery System Based on Thermosensitive Biodegradable Hydrogel. Pharmaceutical Research 2003 20:884-888; and Chang et al., Non-ionic amphiphilic biodegradable PEG-PLGA-PEG copolymer enhances gene delivery efficiency in rat skeletal muscle. J Controlled Release. 2007 118:245-253, the contents of each of which are herein incorporated by reference in their entirety). The RNA (e.g., mRNA) vaccines of the present disclosure may be formulated in lipid nanoparticles comprising the PEG-PLGA-PEG block copolymer.

In some embodiments, the therapeutic nanoparticle may comprise a multiblock copolymer (see e.g., U.S. Pat. Nos. 8,263,665 and 8,287,910 and U.S. Patent Pub. No. US20130195987, the contents of each of which are herein incorporated by reference in their entirety).

In some embodiments, the block copolymers described herein may be included in a polyion complex comprising a non-polymeric micelle and the block copolymer. (see e.g., U.S. Publication No. 20120076836, the contents of which are herein incorporated by reference in their entirety).

In some embodiments, the therapeutic nanoparticle may comprise at least one acrylic polymer. Acrylic polymers include but are not limited to, acrylic acid, methacrylic acid, acrylic acid and methacrylic acid copolymers, methyl methacrylate copolymers, ethoxyethyl methacrylates, cyanoethyl methacrylate, amino alkyl methacrylate copolymer, poly(acrylic acid), poly(methacrylic acid), polycyanoacrylates and combinations thereof.

In some embodiments, the therapeutic nanoparticles may comprise at least one poly(vinyl ester) polymer. The poly(vinyl ester) polymer may be a copolymer such as a random copolymer. As a non-limiting example, the random copolymer may have a structure such as those described in International Application No. WO2013032829 or U.S. Patent Publication No US20130121954, the contents of each of which are herein incorporated by reference in their entirety. In some embodiments, the poly(vinyl ester) polymers may be conjugated to the polynucleotides described herein.

In some embodiments, the therapeutic nanoparticle may comprise at least one diblock copolymer. The diblock copolymer may be, but it not limited to, a poly(lactic) acid-poly(ethylene)glycol copolymer (see, e.g., International Patent Publication No. WO2013044219, the contents of which are herein incorporated by reference in their entirety). As a non-limiting example, the therapeutic nanoparticle may be used to treat cancer (see International publication No. WO2013044219, the contents of which are herein incorporated by reference in their entirety).

In some embodiments, the therapeutic nanoparticles may comprise at least one cationic polymer described herein and/or known in the art.

In some embodiments, the therapeutic nanoparticles may comprise at least one amine-containing polymer such as, but not limited to polylysine, polyethylene imine, poly(amidoamine) dendrimers, poly(beta-amino esters) (see, e.g., U.S. Pat. No. 8,287,849, the contents of which are herein incorporated by reference in their entirety) and combinations thereof.

In some embodiments, the nanoparticles described herein may comprise an amine cationic lipid such as those described in International Patent Application No. WO2013059496, the contents of which are herein incorporated by reference in their entirety. In some embodiments, the cationic lipids may have an amino-amine or an amino-amide moiety.

In some embodiments, the therapeutic nanoparticles may comprise at least one degradable polyester which may contain polycationic side chains. Degradeable polyesters include, but are not limited to, poly(serine ester), poly(L-lactide-co-L-lysine), poly(4-hydroxy-L-proline ester), and combinations thereof. In some embodiments, the degradable polyesters may include a PEG conjugation to form a PEGylated polymer.

In some embodiments, the synthetic nanocarriers may contain an immunostimulatory agent to enhance the immune response from delivery of the synthetic nanocarrier. As a non-limiting example, the synthetic nanocarrier may comprise a Th1 immunostimulatory agent, which may enhance a Th1-based response of the immune system (see International Pub No. WO2010123569 and U.S. Publication No. US20110223201, the contents of each of which are herein incorporated by reference in their entirety).

In some embodiments, the synthetic nanocarriers may be formulated for targeted release. In some embodiments, the synthetic nanocarrier is formulated to release the polynucleotides at a specified pH and/or after a desired time interval. As a non-limiting example, the synthetic nanoparticle may be formulated to release the RNA (e.g., mRNA) vaccines after 24 hours and/or at a pH of 4.5 (see International Publication Nos. WO2010138193 and WO2010138194 and US Pub Nos. US20110020388 and US20110027217, each of which is herein incorporated by reference in their entireties).

In some embodiments, the synthetic nanocarriers may be formulated for controlled and/or sustained release of the polynucleotides described herein. As a non-limiting example, the synthetic nanocarriers for sustained release may be formulated by methods known in the art, described herein and/or as described in International Pub No. WO2010138192 and US Pub No. 20100303850, each of which is herein incorporated by reference in their entirety.

In some embodiments, the RNA (e.g., mRNA) vaccine may be formulated for controlled and/or sustained release wherein the formulation comprises at least one polymer that is a crystalline side chain (CYSC) polymer. CYSC polymers are described in U.S. Pat. No. 8,399,007, herein incorporated by reference in its entirety.

In some embodiments, the synthetic nanocarrier may be formulated for use as a vaccine. In some embodiments, the synthetic nanocarrier may encapsulate at least one polynucleotide which encode at least one antigen. As a non-limiting example, the synthetic nanocarrier may include at least one antigen and an excipient for a vaccine dosage form (see International Publication No. WO2011150264 and U.S. Publication No. US20110293723, the contents of each of which are herein incorporated by reference in their entirety). As another non-limiting example, a vaccine dosage form may include at least two synthetic nanocarriers with the same or different antigens and an excipient (see International Publication No. WO2011150249 and U.S. Publication No. US20110293701, the contents of each of which are herein incorporated by reference in their entirety). The vaccine dosage form may be selected by methods described herein, known in the art and/or described in International Publication No. WO2011150258 and U.S. Publication No. US20120027806, the contents of each of which are herein incorporated by reference in their entirety).

In some embodiments, the synthetic nanocarrier may comprise at least one polynucleotide which encodes at least one adjuvant. As non-limiting example, the adjuvant may comprise dimethyldioctadecylammonium-bromide, dimethyldioctadecylammonium-chloride, dimethyldioctadecylammonium-phosphate or dimethyldioctadecylammonium-acetate (DDA) and an apolar fraction or part of said apolar fraction of a total lipid extract of a mycobacterium (see, e.g., U.S. Pat. No. 8,241,610, the content of which is herein incorporated by reference in its entirety). In some embodiments, the synthetic nanocarrier may comprise at least one polynucleotide and an adjuvant. As a non-limiting example, the synthetic nanocarrier comprising and adjuvant may be formulated by the methods described in International Publication No. WO2011150240 and U.S. Publication No. US20110293700, the contents of each of which are herein incorporated by reference in their entirety.

In some embodiments, the synthetic nanocarrier may encapsulate at least one polynucleotide that encodes a peptide, fragment or region from a virus. As a non-limiting example, the synthetic nanocarrier may include, but is not limited to, any of the nanocarriers described in International Publication No. WO2012024621, WO201202629, WO2012024632 and U.S. Publication No. US20120064110, US20120058153 and US20120058154, the contents of each of which are herein incorporated by reference in their entirety.

In some embodiments, the synthetic nanocarrier may be coupled to a polynucleotide which may be able to trigger a humoral and/or cytotoxic T lymphocyte (CTL) response (see, e.g., International Publication No. WO2013019669, the contents of which are herein incorporated by reference in their entirety).

In some embodiments, the RNA (e.g., mRNA) vaccine may be encapsulated in, linked to and/or associated with zwitterionic lipids. Non-limiting examples of zwitterionic lipids and methods of using zwitterionic lipids are described in U.S. Patent Publication No. US20130216607, the contents of which are herein incorporated by reference in their entirety. In some aspects, the zwitterionic lipids may be used in the liposomes and lipid nanoparticles described herein.

In some embodiments, the RNA (e.g., mRNA) vaccine may be formulated in colloid nanocarriers as described in U.S. Patent Publication No. US20130197100, the contents of which are herein incorporated by reference in their entirety.

In some embodiments, the nanoparticle may be optimized for oral administration. The nanoparticle may comprise at least one cationic biopolymer such as, but not limited to, chitosan or a derivative thereof. As a non-limiting example, the nanoparticle may be formulated by the methods described in U.S. Publication No. 20120282343, the contents of which are herein incorporated by reference in their entirety.

In some embodiments, LNPs comprise the lipid KL52 (an amino-lipid disclosed in U.S. Application Publication No. 2012/0295832, the contents of which are herein incorporated by reference in their entirety. Activity and/or safety (as measured by examining one or more of ALT/AST, white blood cell count and cytokine induction, for example) of LNP administration may be improved by incorporation of such lipids. LNPs comprising KL52 may be administered intravenously and/or in one or more doses. In some embodiments, administration of LNPs comprising KL52 results in equal or improved mRNA and/or protein expression as compared to LNPs comprising MC3.

In some embodiments, RNA (e.g., mRNA) vaccine may be delivered using smaller LNPs. Such particles may comprise a diameter from below 0.1 um up to 100 nm such as, but not limited to, less than 0.1 um, less than 1.0 um, less than 5 um, less than 10 um, less than 15 um, less than 20 um, less than 25 um, less than 30 um, less than 35 um, less than 40 um, less than 50 um, less than 55 um, less than 60 um, less than 65 um, less than 70 um, less than 75 um, less than 80 um, less than 85 um, less than 90 um, less than 95 um, less than 100 um, less than 125 um, less than 150 um, less than 175 um, less than 200 um, less than 225 um, less than 250 um, less than 275 um, less than 300 um, less than 325 um, less than 350 um, less than 375 um, less than 400 um, less than 425 um, less than 450 um, less than 475 um, less than 500 um, less than 525 um, less than 550 um, less than 575 um, less than 600 um, less than 625 um, less than 650 um, less than 675 um, less than 700 um, less than 725 um, less than 750 um, less than 775 um, less than 800 um, less than 825 um, less than 850 um, less than 875 um, less than 900 um, less than 925 um, less than 950 um, less than 975 um, or less than 1000 um.

In some embodiments, RNA (e.g., mRNA) vaccines may be delivered using smaller LNPs, which may comprise a diameter from about 1 nm to about 100 nm, from about 1 nm to about 10 nm, about 1 nm to about 20 nm, from about 1 nm to about 30 nm, from about 1 nm to about 40 nm, from about 1 nm to about 50 nm, from about 1 nm to about 60 nm, from about 1 nm to about 70 nm, from about 1 nm to about 80 nm, from about 1 nm to about 90 nm, from about 5 nm to about from 100 nm, from about 5 nm to about 10 nm, about 5 nm to about 20 nm, from about 5 nm to about 30 nm, from about 5 nm to about 40 nm, from about 5 nm to about 50 nm, from about 5 nm to about 60 nm, from about 5 nm to about 70 nm, from about 5 nm to about 80 nm, from about 5 nm to about 90 nm, about 10 to about 50 nm, from about 20 to about 50 nm, from about 30 to about 50 nm, from about 40 to about 50 nm, from about 20 to about 60 nm, from about 30 to about 60 nm, from about 40 to about 60 nm, from about 20 to about 70 nm, from about 30 to about 70 nm, from about 40 to about 70 nm, from about 50 to about 70 nm, from about 60 to about 70 nm, from about 20 to about 80 nm, from about 30 to about 80 nm, from about 40 to about 80 nm, from about 50 to about 80 nm, from about 60 to about 80 nm, from about 20 to about 90 nm, from about 30 to about 90 nm, from about 40 to about 90 nm, from about 50 to about 90 nm, from about 60 to about 90 nm and/or from about 70 to about 90 nm.

In some embodiments, such LNPs are synthesized using methods comprising microfluidic mixers. Examples of microfluidic mixers may include, but are not limited to, a slit interdigital micromixer including, but not limited to those manufactured by Microinnova (Allerheiligen bei Wildon, Austria) and/or a staggered herringbone micromixer (SHM) (Zhigaltsev, I. V. et al., Bottom-up design and synthesis of limit size lipid nanoparticle systems with aqueous and triglyceride cores using millisecond microfluidic mixing have been published (Langmuir. 2012. 28:3633-40; Belliveau, N. M. et al., Microfluidic synthesis of highly potent limit-size lipid nanoparticles for in vivo delivery of siRNA. Molecular Therapy-Nucleic Acids. 2012. 1:e37; Chen, D. et al., Rapid discovery of potent siRNA-containing lipid nanoparticles enabled by controlled microfluidic formulation. J Am Chem Soc. 2012. 134(16):6948-51, the contents of each of which are herein incorporated by reference in their entirety). In some embodiments, methods of LNP generation comprising SHM, further comprise the mixing of at least two input streams wherein mixing occurs by microstructure-induced chaotic advection (MICA). According to this method, fluid streams flow through channels present in a herringbone pattern, causing rotational flow and folding the fluids around each other. This method may also comprise a surface for fluid mixing wherein the surface changes orientations during fluid cycling. Methods of generating LNPs using SHM include those disclosed in U.S. Application Publication Nos. 2004/0262223 and 2012/0276209, the contents of each of which are herein incorporated by reference in their entirety.

In some embodiments, the RNA (e.g., mRNA) vaccine of the present disclosure may be formulated in lipid nanoparticles created using a micromixer such as, but not limited to, a Slit Interdigital Microstructured Mixer (SIMM-V2) or a Standard Slit Interdigital Micro Mixer (SSIMM) or Caterpillar (CPMM) or Impinging jet (IJMM) from the Institut far Mikrotechnik Mainz GmbH, Mainz Germany.

In some embodiments, the RNA (e.g., mRNA) vaccines of the present disclosure may be formulated in lipid nanoparticles created using microfluidic technology (see, e.g., Whitesides, George M. The Origins and the Future of Microfluidics. Nature, 2006 442: 368-373; and Abraham et al. Chaotic Mixer for Microchannels. Science, 2002 295: 647-651; each of which is herein incorporated by reference in its entirety). As a non-limiting example, controlled microfluidic formulation includes a passive method for mixing streams of steady pressure-driven flows in micro channels at a low Reynolds number (see, e.g., Abraham et al. Chaotic Mixer for Microchannels. Science, 2002 295: 647-651, the contents of which are herein incorporated by reference in their entirety).

In some embodiments, the RNA (e.g., mRNA) vaccines of the present disclosure may be formulated in lipid nanoparticles created using a micromixer chip such as, but not limited to, those from Harvard Apparatus (Holliston, Mass.) or Dolomite Microfluidics (Royston, UK). A micromixer chip can be used for rapid mixing of two or more fluid streams with a split and recombine mechanism.

In some embodiments, the RNA (e.g., mRNA) vaccines of the disclosure may be formulated for delivery using the drug encapsulating microspheres described in International Patent Publication No. WO2013063468 or U.S. Pat. No. 8,440,614, the contents of each of which are herein incorporated by reference in their entirety. The microspheres may comprise a compound of the formula (I), (II), (III), (IV), (V) or (VI) as described in International Patent Publication No. WO2013063468, the contents of which are herein incorporated by reference in their entirety. In some embodiments, the amino acid, peptide, polypeptide, and/or lipids are useful in delivering the RNA (e.g., mRNA) vaccines of the disclosure to cells (see International Patent Publication No. WO2013063468, the contents of which are herein incorporated by reference in their entirety).

In some embodiments, the RNA (e.g., mRNA) vaccines of the disclosure may be formulated in lipid nanoparticles having a diameter from about 10 to about 100 nm such as, but not limited to, about 10 to about 20 nm, about 10 to about 30 nm, about 10 to about 40 nm, about 10 to about 50 nm, about 10 to about 60 nm, about 10 to about 70 nm, about 10 to about 80 nm, about 10 to about 90 nm, about 20 to about 30 nm, about 20 to about 40 nm, about 20 to about 50 nm, about 20 to about 60 nm, about 20 to about 70 nm, about 20 to about 80 nm, about 20 to about 90 nm, about 20 to about 100 nm, about 30 to about 40 nm, about 30 to about 50 nm, about 30 to about 60 nm, about 30 to about 70 nm, about 30 to about 80 nm, about 30 to about 90 nm, about 30 to about 100 nm, about 40 to about 50 nm, about 40 to about 60 nm, about 40 to about 70 nm, about 40 to about 80 nm, about 40 to about 90 nm, about 40 to about 100 nm, about 50 to about 60 nm, about 50 to about 70 nm about 50 to about 80 nm, about 50 to about 90 nm, about 50 to about 100 nm, about 60 to about 70 nm, about 60 to about 80 nm, about 60 to about 90 nm, about 60 to about 100 nm, about 70 to about 80 nm, about 70 to about 90 nm, about 70 to about 100 nm, about 80 to about 90 nm, about 80 to about 100 nm and/or about 90 to about 100 nm.

In some embodiments, the lipid nanoparticles may have a diameter from about 10 to 500 nm.

In some embodiments, the lipid nanoparticle may have a diameter greater than 100 nm, greater than 150 nm, greater than 200 nm, greater than 250 nm, greater than 300 nm, greater than 350 nm, greater than 400 nm, greater than 450 nm, greater than 500 nm, greater than 550 nm, greater than 600 nm, greater than 650 nm, greater than 700 nm, greater than 750 nm, greater than 800 nm, greater than 850 nm, greater than 900 nm, greater than 950 nm or greater than 1000 nm.

In some embodiments, the lipid nanoparticle may be a limit size lipid nanoparticle described in International Patent Publication No. WO2013059922, the contents of which are herein incorporated by reference in their entirety. The limit size lipid nanoparticle may comprise a lipid bilayer surrounding an aqueous core or a hydrophobic core; where the lipid bilayer may comprise a phospholipid such as, but not limited to, diacylphosphatidylcholine, a diacylphosphatidylethanolamine, a ceramide, a sphingomyelin, a dihydrosphingomyelin, a cephalin, a cerebroside, a C8-C20 fatty acid diacylphophatidylcholine, and 1-palmitoyl-2-oleoyl phosphatidylcholine (POPC). In some embodiments, the limit size lipid nanoparticle may comprise a polyethylene glycol-lipid such as, but not limited to, DLPE-PEG, DMPE-PEG, DPPC-PEG and DSPE-PEG.

In some embodiments, the RNA (e.g., mRNA) vaccines may be delivered, localized and/or concentrated in a specific location using the delivery methods described in International Patent Publication No. WO2013063530, the contents of which are herein incorporated by reference in their entirety. As a non-limiting example, a subject may be administered an empty polymeric particle prior to, simultaneously with or after delivering the RNA (e.g., mRNA) vaccines to the subject. The empty polymeric particle undergoes a change in volume once in contact with the subject and becomes lodged, embedded, immobilized or entrapped at a specific location in the subject.

In some embodiments, the RNA (e.g., mRNA) vaccines may be formulated in an active substance release system (see, e.g., U.S. Patent Publication No. US20130102545, the contents of which are herein incorporated by reference in their entirety). The active substance release system may comprise 1) at least one nanoparticle bonded to an oligonucleotide inhibitor strand which is hybridized with a catalytically active nucleic acid and 2) a compound bonded to at least one substrate molecule bonded to a therapeutically active substance (e.g., polynucleotides described herein), where the therapeutically active substance is released by the cleavage of the substrate molecule by the catalytically active nucleic acid.

In some embodiments, the RNA (e.g., mRNA) vaccines may be formulated in a nanoparticle comprising an inner core comprising a non-cellular material and an outer surface comprising a cellular membrane. The cellular membrane may be derived from a cell or a membrane derived from a virus. As a non-limiting example, the nanoparticle may be made by the methods described in International Patent Publication No. WO2013052167, the contents of which are herein incorporated by reference in their entirety. As another non-limiting example, the nanoparticle described in International Patent Publication No. WO2013052167, the contents of which are herein incorporated by reference in their entirety, may be used to deliver the RNA (e.g., mRNA) vaccines described herein.

In some embodiments, the RNA (e.g., mRNA) vaccines may be formulated in porous nanoparticle-supported lipid bilayers (protocells). Protocells are described in International Patent Publication No. WO2013056132, the contents of which are herein incorporated by reference in their entirety.

In some embodiments, the RNA (e.g., mRNA) vaccines described herein may be formulated in polymeric nanoparticles as described in or made by the methods described in U.S. Pat. Nos. 8,420,123 and 8,518,963 and European Patent No. EP2073848B1, the contents of each of which are herein incorporated by reference in their entirety. As a non-limiting example, the polymeric nanoparticle may have a high glass transition temperature such as the nanoparticles described in or nanoparticles made by the methods described in U.S. Pat. No. 8,518,963, the contents of which are herein incorporated by reference in their entirety. As another non-limiting example, the polymer nanoparticle for oral and parenteral formulations may be made by the methods described in European Patent No. EP2073848B1, the contents of which are herein incorporated by reference in their entirety.

In some embodiments, the RNA (e.g., mRNA) vaccines described herein may be formulated in nanoparticles used in imaging. The nanoparticles may be liposome nanoparticles such as those described in U.S. Patent Publication No US20130129636, herein incorporated by reference in its entirety. As a non-limiting example, the liposome may comprise gadolinium(III)2-{4,7-bis-carboxymethyl-10-[(N,N-distearylamidomethyl-N'-amido-methyl]-1,4,7,10-tetra-azacyclododec-1-yl}-acetic acid and a neutral, fully saturated phospholipid component (see, e.g., U.S. Patent Publication No US20130129636, the contents of which are herein incorporated by reference in their entirety).

In some embodiments, the nanoparticles which may be used in the present disclosure are formed by the methods described in U.S. Patent Application No. US20130130348, the contents of which are herein incorporated by reference in their entirety.

The nanoparticles of the present disclosure may further include nutrients such as, but not limited to, those which deficiencies can lead to health hazards from anemia to neural tube defects (see, e.g., the nanoparticles described in International Patent Publication No WO2013072929, the contents of which are herein incorporated by reference in their entirety). As a non-limiting example, the nutrient may be iron in the form of ferrous, ferric salts or elemental iron, iodine, folic acid, vitamins or micronutrients.

In some embodiments, the RNA (e.g., mRNA) vaccines of the present disclosure may be formulated in a swellable nanoparticle. The swellable nanoparticle may be, but is not limited to, those described in U.S. Pat. No. 8,440,231, the contents of which are herein incorporated by reference in their entirety. As a non-limiting embodiment, the swellable nanoparticle may be used for delivery of the RNA (e.g., mRNA) vaccines of the present disclosure to the pulmonary system (see, e.g., U.S. Pat. No. 8,440,231, the contents of which are herein incorporated by reference in their entirety).

The RNA (e.g., mRNA) vaccines of the present disclosure may be formulated in polyanhydride nanoparticles such as, but not limited to, those described in U.S. Pat. No. 8,449,916, the contents of which are herein incorporated by reference in their entirety.

The nanoparticles and microparticles of the present disclosure may be geometrically engineered to modulate macrophage and/or the immune response. In some embodiments, the geometrically engineered particles may have varied shapes, sizes and/or surface charges in order to incorporated the polynucleotides of the present disclosure for targeted delivery such as, but not limited to, pulmonary delivery (see, e.g., International Publication No WO2013082111, the contents of which are herein incorporated by reference in their entirety). Other physical features the geometrically engineering particles may have include, but are not limited to, fenestrations, angled arms, asymmetry and surface roughness, and charge which can alter the interactions with cells and tissues. As a non-limiting example, nanoparticles of the present disclosure may be made by the methods described in International Publication No WO2013082111, the contents of which are herein incorporated by reference in their entirety.

In some embodiments, the nanoparticles of the present disclosure may be water soluble nanoparticles such as, but not limited to, those described in International Publication No. WO2013090601, the contents of which are herein incorporated by reference in their entirety. The nanoparticles may be inorganic nanoparticles which have a compact and zwitterionic ligand in order to exhibit good water solubility. The nanoparticles may also have small hydrodynamic diameters (HD), stability with respect to time, pH, and salinity and a low level of non-specific protein binding.

In some embodiments the nanoparticles of the present disclosure may be developed by the methods described in U.S. Patent Publication No. US20130172406, the contents of which are herein incorporated by reference in their entirety.

In some embodiments, the nanoparticles of the present disclosure are stealth nanoparticles or target-specific stealth nanoparticles such as, but not limited to, those described in U.S. Patent Publication No. US20130172406, the contents of which are herein incorporated by reference in their entirety. The nanoparticles of the present disclosure may be made by the methods described in U.S. Patent Publication No. US20130172406, the contents of which are herein incorporated by reference in their entirety.

In some embodiments, the stealth or target-specific stealth nanoparticles may comprise a polymeric matrix. The polymeric matrix may comprise two or more polymers such as, but not limited to, polyethylenes, polycarbonates, polyanhydrides, polyhydroxyacids, polypropylfumerates, polycaprolactones, polyamides, polyacetals, polyethers, polyesters, poly(orthoesters), polycyanoacrylates, polyvinyl alcohols, polyurethanes, polyphosphazenes, polyacrylates, polymethacrylates, polycyanoacrylates, polyureas, polystyrenes, polyamines, polyesters, polyanhydrides, polyethers, polyurethanes, polymethacrylates, polyacrylates, polycyanoacrylates or combinations thereof.

In some embodiments, the nanoparticle may be a nanoparticle-nucleic acid hybrid structure having a high density nucleic acid layer. As a non-limiting example, the nanoparticle-nucleic acid hybrid structure may made by the methods described in U.S. Patent Publication No. US20130171646, the contents of which are herein incorporated by reference in their entirety. The nanoparticle may comprise a nucleic acid such as, but not limited to, polynucleotides described herein and/or known in the art.

At least one of the nanoparticles of the present disclosure may be embedded in the core of a nanostructure or coated with a low density porous 3-D structure or coating which is capable of carrying or associating with at least one payload within or on the surface of the nanostructure. Non-limiting examples of the nanostructures comprising at least one nanoparticle are described in International Patent Publication No. WO2013123523, the contents of which are herein incorporated by reference in their entirety.

In some embodiments the RNA (e.g., mRNA) vaccine may be associated with a cationic or polycationic compounds, including protamine, nucleoline, spermine or spermidine, or other cationic peptides or proteins, such as poly-L-lysine (PLL), polyarginine, basic polypeptides, cell penetrating peptides (CPPs), including HIV-binding peptides, HIV-1 Tat (HIV), Tat-derived peptides, Penetratin, VP$^{22}$ derived or analog peptides, Pestivirus Erns, HSINV, VP$^{22}$ (Herpes simplex), MAP, KALA or protein transduction domains (PTDs), PpT620, prolin-rich peptides, arginine-rich peptides, lysine-rich peptides, MPG-peptide(s), Pep-1, L-oligomers, Calcitonin peptide(s), Antennapedia-derived peptides (particularly from *Drosophila* antennapedia), pAntp, pIsI, FGF, Lactoferrin, Transportan, Buforin-2, Bac715-24, SynB, SynB, pVEC, hCT-derived peptides, SAP, histones, cationic polysaccharides, for example chitosan, polybrene, cationic polymers, e.g. polyethyleneimine (PEI), cationic lipids, e.g. DOTMA: [1-(2,3-sioleyloxy) propyl)]-N,N,N-trimethylammonium chloride, DMRIE, di-C14-amidine, DOTIM, SAINT, DC-Chol, BGTC, CTAP, DOPC, DODAP, DOPE: Dioleyl phosphatidylethanolamine, DOSPA, DODAB, DOIC, DMEPC, DOGS: Dioctadecylamidoglicylspermin, DIMRI: Dimyristooxypropyl dimethyl hydroxyethyl ammonium bromide, DOTAP: dioleyloxy-3-(trimethylammonio)propane, DC-6-14: O,O-ditetradecanoyl-N-.alpha.-trimethylammonioacetyl)diethanolamine chloride, CLIP 1: rac-[(2,3-dioctadecyloxypropyl) (2-hydroxyethyl)]-dimethylammonium chloride, CLIP6: rac-[2(2,3-dihexadecyloxypropyloxymethyloxy)ethyl]-trimethylammonium, CLIP9: rac-[2(2,3-dihexadecyloxypropyloxysuccinyloxy)ethyl]-trimethylammo-nium, oligofectamine, or cationic or polycationic polymers, e.g. modified polyaminoacids, such as beta-aminoacid-polymers or reversed polyamides, etc., modified polyethylenes, such as PVP (poly(N-ethyl-4-vinylpyridinium bromide)), etc., modified acrylates, such as pDMAEMA (poly(dimethylaminoethyl methylacrylate)), etc., modified amidoamines such as pAMAM (poly(amidoamine)), etc., modified polybetaminoester (PBAE), such as diamine end modified 1,4 butanediol diacrylate-co-5-amino-1-pentanol polymers, etc., dendrimers, such as polypropylamine dendrimers or pAMAM based dendrimers, etc., polyimine(s), such as PEI: poly(ethyleneimine), poly(propyleneimine), etc., polyallylamine, sugar backbone based polymers, such as cyclodextrin based polymers, dextran based polymers, chitosan, etc., silan backbone based polymers, such as PMOXA-PDMS copolymers, etc., blockpolymers consisting of a combination of one or more cationic blocks (e.g. selected from a cationic polymer as mentioned above) and of one or more hydrophilic or hydrophobic blocks (e.g. polyethyleneglycole), etc.

In other embodiments the RNA (e.g., mRNA) vaccine is not associated with a cationic or polycationic compounds.

In some embodiments, a nanoparticle comprises compounds of Formula (I):

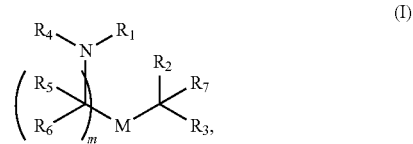

or a salt or isomer thereof, wherein:

$R_1$ is selected from the group consisting of $C_{5-30}$ alkyl, $C_{5-20}$ alkenyl, —R*YR", —YR", and —R"'M'R';

$R_2$ and $R_3$ are independently selected from the group consisting of H, $C_{1-14}$ alkyl, $C_{2-14}$ alkenyl, —R*YR", —YR", and —R*OR", or $R_2$ and $R_3$, together with the atom to which they are attached, form a heterocycle or carbocycle;

$R_4$ is selected from the group consisting of a $C_{3-6}$ carbocycle, —(CH$_2$)$_n$Q, —(CH$_2$)$_n$CHQR, —CHQR, —CQ(R)$_2$, and unsubstituted $C_{1-6}$ alkyl, where Q is selected from a carbocycle, heterocycle, —OR, —O(CH$_2$)$_n$N(R)$_2$, —C(O)OR, —OC(O)R, —CX$_3$, —CX$_2$H, —CXH$_2$, —CN, —N(R)$_2$, —C(O)N(R)$_2$, —N(R)C(O)R, —N(R)S(O)$_2$R, —N(R)C(O)N(R)$_2$, —N(R)C(S)N(R)$_2$, —N(R)R$_8$, —O(CH$_2$)—OR, —N(R)C(=NR$_9$)N(R)$_2$, —N(R)C(=CHR$_9$)N(R)$_2$, —OC(O)N(R)$_2$, —N(R)C(O)OR, —N(OR)C(O)R, —N(OR)S(O)$_2$R, —N(OR)C(O)OR, —N(OR)C(O)N(R)$_2$, —N(OR)C(S)N(R)$_2$, —N(OR)C(=NR$_9$)N(R)$_2$, —N(OR)C(=CHR$_9$)N(R)$_2$, —C(=NR$_9$)N(R)$_2$, —C(=NR$_9$)R, —C(O)N(R)OR, and —C(R)N(R)$_2$C(O)OR, and each n is independently selected from 1, 2, 3, 4, and 5;

each $R_5$ is independently selected from the group consisting of $C_{1-3}$ alkyl, $C_{2-3}$ alkenyl, and H;

each $R_6$ is independently selected from the group consisting of $C_{1-3}$ alkyl, $C_{2-3}$ alkenyl, and H;

M and M' are independently selected from —C(O)O—, —OC(O)—, —C(O)N(R')—, —N(R')C(O)—, —C(O)—, —C(S)—, —C(S)S—, —SC(S)—, —CH(OH)—, —P(O)(OR')O—, —S(O)$_2$—, —S—S—, an aryl group, and a heteroaryl group;

$R_7$ is selected from the group consisting of $C_{1-3}$ alkyl, $C_{2-3}$ alkenyl, and H;

$R_8$ is selected from the group consisting of $C_{3-6}$ carbocycle and heterocycle;

$R_9$ is selected from the group consisting of H, CN, NO$_2$, $C_{1-6}$ alkyl, —OR, —S(O)$_2$R, —S(O)$_2$N(R)$_2$, $C_{2-6}$ alkenyl, $C_{3-6}$ carbocycle and heterocycle;

each R is independently selected from the group consisting of $C_{1-3}$ alkyl, $C_{2-3}$ alkenyl, and H;

each R' is independently selected from the group consisting of $C_{1-18}$ alkyl, $C_{2-18}$ alkenyl, —R*YR", —YR", and H;

each R" is independently selected from the group consisting of $C_{3-14}$ alkyl and $C_{3-14}$ alkenyl;

each R* is independently selected from the group consisting of $C_{1-12}$ alkyl and $C_{2-12}$ alkenyl;

each Y is independently a $C_{3-6}$ carbocycle;

each X is independently selected from the group consisting of F, Cl, Br, and I; and m is selected from 5, 6, 7, 8, 9, 10, 11, 12, and 13.

In some embodiments, a subset of compounds of Formula (I) includes those in which when $R_4$ is —$(CH_2)_nQ$, —$(CH_2)_n$CHQR, —CHQR, or —$CQ(R)_2$, then (i) Q is not —$N(R)_2$ when n is 1, 2, 3, 4 or 5, or (ii) Q is not 5, 6, or 7-membered heterocycloalkyl when n is 1 or 2.

In some embodiments, another subset of compounds of Formula (I) includes those in which $R_1$ is selected from the group consisting of $C_{5-30}$ alkyl, $C_{5-20}$ alkenyl, —R*YR″, —YR″, and —R″M′R′;

$R_2$ and $R_3$ are independently selected from the group consisting of H, $C_{1-14}$ alkyl, $C_{2-14}$ alkenyl, —R*YR″, —YR″, and —R*OR″, or $R_2$ and $R_3$, together with the atom to which they are attached, form a heterocycle or carbocycle;

$R_4$ is selected from the group consisting of a $C_{3-6}$ carbocycle, —$(CH_2)_nQ$, —$(CH_2)_n$CHQR, —CHQR, —$CQ(R)_2$, and unsubstituted $C_{1-6}$ alkyl, where Q is selected from a $C_{3-6}$ carbocycle, a 5- to 14-membered heteroaryl having one or more heteroatoms selected from N, O, and S, —OR, —$O(CH_2)$—$N(R)_2$, —C(O)OR, —OC(O)R, —$CX_3$, —$CX_2H$, —$CXH_2$, —CN, —$C(O)N(R)_2$, —N(R)C(O)R, —$N(R)S(O)_2R$, —$N(R)C(O)N(R)_2$, —$N(R)C(S)N(R)_2$, —$CRN(R)_2C(O)OR$, —$N(R)R_8$, —$O(CH_2)$—OR, —$N(R)C(=NR_9)N(R)_2$, —$N(R)C(=CHR_9)N(R)_2$, —$OC(O)N(R)_2$, —N(R)C(O)OR, —N(OR)C(O)R, —$N(OR)S(O)_2R$, —N(OR)C(O)OR, —$N(OR)C(O)N(R)_2$, —N(OR)C(S)N(R)_2, —$N(OR)C(=NR_9)N(R)_2$, —$N(OR)C(=CHR_9)N(R)_2$, —$C(=NR_9)N(R)_2$, —$C(=NR_9)R$, —C(O)N(R)OR, and a 5- to 14-membered heterocycloalkyl having one or more heteroatoms selected from N, O, and S which is substituted with one or more substituents selected from oxo (=O), OH, amino, mono- or di-alkylamino, and $C_{1-3}$ alkyl, and each n is independently selected from 1, 2, 3, 4, and 5;

each $R_5$ is independently selected from the group consisting of $C_{1-3}$ alkyl, $C_{2-3}$ alkenyl, and H;

each $R_6$ is independently selected from the group consisting of $C_{1-3}$ alkyl, $C_{2-3}$ alkenyl, and H;

M and M′ are independently selected from —C(O)O—, —OC(O)—, —C(O)N(R′)—, —N(R′)C(O)—, —C(O)—, —C(S)—, —C(S)S—, —SC(S)—, —CH(OH)—, —P(O)(OR′)O—, —$S(O)_2$—, —S—S—, an aryl group, and a heteroaryl group;

$R_7$ is selected from the group consisting of $C_{1-3}$ alkyl, $C_{2-3}$ alkenyl, and H;

$R_8$ is selected from the group consisting of $C_{3-6}$ carbocycle and heterocycle;

$R_9$ is selected from the group consisting of H, CN, $NO_2$, $C_{1-6}$ alkyl, —OR, —$S(O)_2R$, —$S(O)_2N(R)_2$, $C_{2-6}$ alkenyl, $C_{3-6}$ carbocycle and heterocycle;

each R is independently selected from the group consisting of $C_{1-3}$ alkyl, $C_{2-3}$ alkenyl, and H;

each R′ is independently selected from the group consisting of $C_{1-18}$ alkyl, $C_{2-18}$ alkenyl, —R*YR″, —YR″, and H;

each R″ is independently selected from the group consisting of $C_{3-14}$ alkyl and $C_{3-14}$ alkenyl;

each R* is independently selected from the group consisting of $C_{1-12}$ alkyl and $C_{2-12}$ alkenyl;

each Y is independently a $C_{3-6}$ carbocycle;

each X is independently selected from the group consisting of F, Cl, Br, and I; and m is selected from 5, 6, 7, 8, 9, 10, 11, 12, and 13, or salts or isomers thereof.

In some embodiments, another subset of compounds of Formula (I) includes those in which $R_1$ is selected from the group consisting of $C_{5-30}$ alkyl, $C_{5-20}$ alkenyl, —R*YR″, —YR″, and —R″M′R′;

$R_2$ and $R_3$ are independently selected from the group consisting of H, $C_{1-14}$ alkyl, $C_{2-14}$ alkenyl, —R*YR″, —YR″, and —R*OR″, or $R_2$ and $R_3$, together with the atom to which they are attached, form a heterocycle or carbocycle;

$R_4$ is selected from the group consisting of a $C_{3-6}$ carbocycle, —$(CH_2)_nQ$, —$(CH_2)_n$CHQR, —CHQR, —$CQ(R)_2$, and unsubstituted $C_{1-6}$ alkyl, where Q is selected from a $C_{3-6}$ carbocycle, a 5- to 14-membered heterocycle having one or more heteroatoms selected from N, O, and S, —OR, —$O(CH_2)$—$N(R)_2$, —C(O)OR, —OC(O)R, —$CX_3$, —$CX_2H$, —$CXH_2$, —CN, —$C(O)N(R)_2$, —N(R)C(O)R, —$N(R)S(O)_2R$, —$N(R)C(O)N(R)_2$, —$N(R)C(S)N(R)_2$, —$CRN(R)_2C(O)OR$, —$N(R)R_8$, —$O(CH_2)$—OR, —$N(R)C(=NR_9)N(R)_2$, —$N(R)C(=CHR_9)N(R)_2$, —$OC(O)N(R)_2$, —N(R)C(O)OR, —N(OR)C(O)R, —$N(OR)S(O)_2R$, —N(OR)C(O)OR, —$N(OR)C(O)N(R)_2$, —N(OR)C(S)N(R)_2, —$N(OR)C(=NR_9)N(R)_2$, —$N(OR)C(=CHR_9)N(R)_2$, —$C(=NR_9)R$, —C(O)N(R)OR, and —$C(=NR_9)N(R)_2$, and each n is independently selected from 1, 2, 3, 4, and 5; and when Q is a 5- to 14-membered heterocycle and (i) $R_4$ is —$(CH_2)_nQ$ in which n is 1 or 2, or (ii) $R_4$ is —$(CH_2)_n$CHQR in which n is 1, or (iii) $R_4$ is —CHQR, and —$CQ(R)_2$, then Q is either a 5- to 14-membered heteroaryl or 8- to 14-membered heterocycloalkyl;

each $R_5$ is independently selected from the group consisting of $C_{1-3}$ alkyl, $C_{2-3}$ alkenyl, and H;

each $R_6$ is independently selected from the group consisting of $C_{1-3}$ alkyl, $C_{2-3}$ alkenyl, and H;

M and M′ are independently selected from —C(O)O—, —OC(O)—, —C(O)N(R′)—, —N(R′)C(O)—, —C(O)—, —C(S)—, —C(S)S—, —SC(S)—, —CH(OH)—, —P(O)(OR′)O—, —$S(O)_2$—, —S—S—, an aryl group, and a heteroaryl group;

$R_7$ is selected from the group consisting of $C_{1-3}$ alkyl, $C_{2-3}$ alkenyl, and H;

$R_8$ is selected from the group consisting of $C_{3-6}$ carbocycle and heterocycle;

$R_9$ is selected from the group consisting of H, CN, $NO_2$, $C_{1-6}$ alkyl, —OR, —$S(O)_2R$, —$S(O)_2N(R)_2$, $C_{2-6}$ alkenyl, $C_{3-6}$ carbocycle and heterocycle;

each R is independently selected from the group consisting of $C_{1-3}$ alkyl, $C_{2-3}$ alkenyl, and H;

each R′ is independently selected from the group consisting of $C_{1-18}$ alkyl, $C_{2-18}$ alkenyl, —R*YR″, —YR″, and H;

each R″ is independently selected from the group consisting of $C_{3-14}$ alkyl and $C_{3-14}$ alkenyl;

each R* is independently selected from the group consisting of $C_{1-12}$ alkyl and $C_{2-12}$ alkenyl;

each Y is independently a $C_{3-6}$ carbocycle;

each X is independently selected from the group consisting of F, Cl, Br, and I; and m is selected from 5, 6, 7, 8, 9, 10, 11, 12, and 13, or salts or isomers thereof.

In some embodiments, another subset of compounds of Formula (I) includes those in which $R_1$ is selected from the group consisting of $C_{5-30}$ alkyl, $C_{5-20}$ alkenyl, —R*YR″, —YR″, and —R″M′R′;

$R_2$ and $R_3$ are independently selected from the group consisting of H, $C_{1-14}$ alkyl, $C_{2-14}$ alkenyl, —R*YR″, —YR", and —R*OR", or $R_2$ and $R_3$, together with the atom to which they are attached, form a heterocycle or carbocycle;

$R_4$ is selected from the group consisting of a $C_{3-6}$ carbocycle, —$(CH_2)_nQ$, —$(CH_2)_nCHQR$, —CHQR, —$CQ(R)_2$, and unsubstituted $C_{1-6}$ alkyl, where Q is selected from a $C_{3-6}$ carbocycle, a 5- to 14-membered heteroaryl having one or more heteroatoms selected from N, O, and S, —OR, —$O(CH_2)_nN(R)_2$, —C(O)OR, —OC(O)R, —$CX_3$, —$CX_2H$, —$CXH_2$, —CN, —$C(O)N(R)_2$, —N(R)C(O)R, —N(R)S(O)$_2$R, —N(R)C(O)N(R)$_2$, —N(R)C(S)N(R)$_2$, —CRN(R)$_2$C(O)OR, —N(R)R$_8$, —O(CH$_2$)—OR, —N(R)C(=NR$_9$)N(R)$_2$, —N(R)C(=CHR$_9$)N(R)$_2$, —OC(O)N(R)$_2$, —N(R)C(O)OR, —N(OR)C(O)R, —N(OR)S(O)$_2$R, —N(OR)C(O)OR, —N(OR)C(O)N(R)$_2$, —N(OR)C(S)N(R)$_2$, —N(OR)C(=NR$_9$)N(R)$_2$, —N(OR)C(=CHR$_9$)N(R)$_2$, —C(=NR$_9$)R, —C(O)N(R)OR, and —C(=NR$_9$)N(R)$_2$, and each n is independently selected from 1, 2, 3, 4, and 5;

each $R_5$ is independently selected from the group consisting of $C_{1-3}$ alkyl, $C_{2-3}$ alkenyl, and H;

each $R_6$ is independently selected from the group consisting of $C_{1-3}$ alkyl, $C_{2-3}$ alkenyl, and H;

M and M' are independently selected from —C(O)O—, —OC(O)—, —C(O)N(R')—, —N(R')C(O)—, —C(O)—, —C(S)—, —C(S)S—, —SC(S)—, —CH(OH)—, —P(O)(OR')O—, —S(O)$_2$—, —S—S—, an aryl group, and a heteroaryl group;

$R_7$ is selected from the group consisting of $C_{1-3}$ alkyl, $C_{2-3}$ alkenyl, and H;

$R_8$ is selected from the group consisting of $C_{3-6}$ carbocycle and heterocycle;

$R_9$ is selected from the group consisting of H, CN, NO$_2$, $C_{1-6}$ alkyl, —OR, —S(O)$_2$R, —S(O)$_2$N(R)$_2$, $C_{2-6}$ alkenyl, $C_{3-6}$ carbocycle and heterocycle;

each R is independently selected from the group consisting of $C_{1-3}$ alkyl, $C_{2-3}$ alkenyl, and H;

each R' is independently selected from the group consisting of $C_{1-18}$ alkyl, $C_{2-18}$ alkenyl, —R*YR", —YR", and H;

each R" is independently selected from the group consisting of $C_{3-14}$ alkyl and $C_{3-14}$ alkenyl;

each R* is independently selected from the group consisting of $C_{1-12}$ alkyl and $C_{2-12}$ alkenyl;

each Y is independently a $C_{3-6}$ carbocycle;

each X is independently selected from the group consisting of F, Cl, Br, and I; and m is selected from 5, 6, 7, 8, 9, 10, 11, 12, and 13, or salts or isomers thereof.

In some embodiments, another subset of compounds of Formula (I) includes those in which $R_1$ is selected from the group consisting of $C_{5-30}$ alkyl, $C_{5-20}$ alkenyl, —R*YR", —YR", and —R"M'R';

$R_2$ and $R_3$ are independently selected from the group consisting of H, $C_{2-14}$ alkyl, $C_{2-14}$ alkenyl, —R*YR", —YR", and —R*OR", or $R_2$ and $R_3$, together with the atom to which they are attached, form a heterocycle or carbocycle;

$R_4$ is —$(CH_2)_nQ$ or —$(CH_2)_nCHQR$, where Q is —N(R)$_2$, and n is selected from 3, 4, and 5;

each $R_5$ is independently selected from the group consisting of $C_{1-3}$ alkyl, $C_{2-3}$ alkenyl, and H;

each $R_6$ is independently selected from the group consisting of $C_{1-3}$ alkyl, $C_{2-3}$ alkenyl, and H;

M and M' are independently selected from —C(O)O—, —OC(O)—, —C(O)N(R')—, —N(R')C(O)—, —C(O)—, —C(S)—, —C(S)S—, —SC(S)—, —CH(OH)—, —P(O)(OR')O—, —S(O)$_2$—, —S—S—, an aryl group, and a heteroaryl group;

$R_7$ is selected from the group consisting of $C_{1-3}$ alkyl, $C_{2-3}$ alkenyl, and H;

each R is independently selected from the group consisting of $C_{1-3}$ alkyl, $C_{2-3}$ alkenyl, and H;

each R' is independently selected from the group consisting of $C_{1-18}$ alkyl, $C_{2-18}$ alkenyl, —R*YR", —YR", and H;

each R" is independently selected from the group consisting of $C_{3-14}$ alkyl and $C_{3-14}$ alkenyl;

each R* is independently selected from the group consisting of $C_{1-12}$ alkyl and $C_{1-12}$ alkenyl;

each Y is independently a $C_{3-6}$ carbocycle;

each X is independently selected from the group consisting of F, Cl, Br, and I; and m is selected from 5, 6, 7, 8, 9, 10, 11, 12, and 13, or salts or isomers thereof.

In some embodiments, another subset of compounds of Formula (I) includes those in which $R_1$ is selected from the group consisting of $C_{5-30}$ alkyl, $C_{5-20}$ alkenyl, —R*YR", —YR", and —R"M'R'; $R_2$ and $R_3$ are independently selected from the group consisting of $C_{1-14}$ alkyl, $C_{2-14}$ alkenyl, —R*YR", —YR", and —R*OR", or $R_2$ and $R_3$, together with the atom to which they are attached, form a heterocycle or carbocycle;

$R_4$ is selected from the group consisting of —$(CH_2)_nQ$, —$(CH_2)_nCHQR$, —CHQR, and —$CQ(R)_2$, where Q is —N(R)$_2$, and n is selected from 1, 2, 3, 4, and 5;

each $R_5$ is independently selected from the group consisting of $C_{1-3}$ alkyl, $C_{2-3}$ alkenyl, and H;

each $R_6$ is independently selected from the group consisting of $C_{1-3}$ alkyl, $C_{2-3}$ alkenyl, and H;

M and M' are independently selected from —C(O)O—, —OC(O)—, —C(O)N(R')—, —N(R')C(O)—, —C(O)—, —C(S)—, —C(S)S—, —SC(S)—, —CH(OH)—, —P(O)(OR')O—, —S(O)$_2$—, —S—S—, an aryl group, and a heteroaryl group;

$R_7$ is selected from the group consisting of $C_{1-3}$ alkyl, $C_{2-3}$ alkenyl, and H;

each R is independently selected from the group consisting of $C_{1-3}$ alkyl, $C_{2-3}$ alkenyl, and H;

each R' is independently selected from the group consisting of $C_{1-18}$ alkyl, $C_{2-18}$ alkenyl, —R*YR", —YR", and H;

each R" is independently selected from the group consisting of $C_{3-14}$ alkyl and $C_{3-14}$ alkenyl;

each R* is independently selected from the group consisting of $C_{1-12}$ alkyl and $C_{1-12}$ alkenyl;

each Y is independently a $C_{3-6}$ carbocycle;

each X is independently selected from the group consisting of F, Cl, Br, and I; and m is selected from 5, 6, 7, 8, 9, 10, 11, 12, and 13, or salts or isomers thereof.

In some embodiments, a subset of compounds of Formula (I) includes those of Formula (IA):

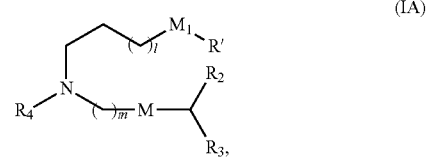

(IA)

or a salt or isomer thereof, wherein l is selected from 1, 2, 3, 4, and 5; m is selected from 5, 6, 7, 8, and 9; $M_1$ is a bond or M'; $R_4$ is unsubstituted $C_{1-3}$ alkyl, or —$(CH_2)_nQ$, in which Q is OH, —NHC(S)N(R)$_2$, —NHC(O)N(R)$_2$, —N(R)C(O)R, —N(R)S(O)$_2$R, —N(R)R$_8$, —NHC(=NR$_9$)N(R)$_2$, —NHC(=CHR$_9$)N(R)$_2$, —OC(O)N(R)$_2$, —N(R)C(O)OR, heteroaryl or heterocycloalkyl; M and M' are independently selected from —C(O)O—, —OC(O)—, —C(O)N(R')—, —P(O)(OR')O—, —S—S—, an aryl group, and a heteroaryl group; and $R_2$ and $R_3$ are independently selected from the group consisting of H, $C_{1-14}$ alkyl, and $C_{2-14}$ alkenyl.

In some embodiments, a subset of compounds of Formula (I) includes those of Formula (II):

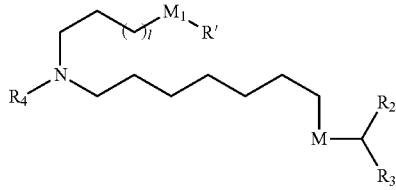

(II)

or a salt or isomer thereof, wherein 1 is selected from 1, 2, 3, 4, and 5; $M_1$ is a bond or M'; $R_4$ is unsubstituted $C_{1-3}$ alkyl, or $-(CH_2)_nQ$, in which n is 2, 3, or 4, and Q is OH, $-NHC(S)N(R)_2$, $-NHC(O)N(R)_2$, $-N(R)C(O)R$, $-N(R)S(O)_2R$, $-N(R)R_8$, $-NHC(=NR_9)N(R)_2$, $-NHC(=CHR_9)N(R)_2$, $-OC(O)N(R)_2$, $-N(R)C(O)OR$, heteroaryl or heterocycloalkyl; M and M' are independently selected from $-C(O)O-$, $-OC(O)-$, $-C(O)N(R')-$, $-P(O)(OR')O-$, $-S-S-$, an aryl group, and a heteroaryl group; and $R_2$ and $R_3$ are independently selected from the group consisting of H, $C_{1-14}$ alkyl, and $C_{2-14}$ alkenyl.

In some embodiments, a subset of compounds of Formula (I) includes those of Formula (IIa), (IIb), (IIc), or (IIe):

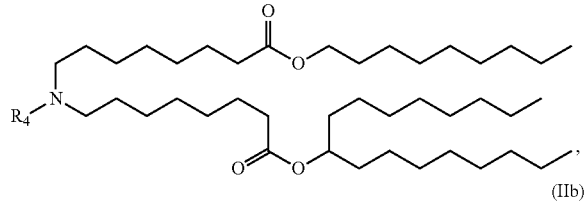

(IIa)

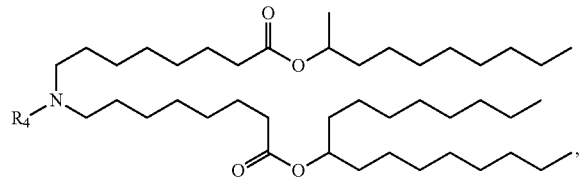

(IIb)

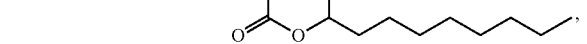

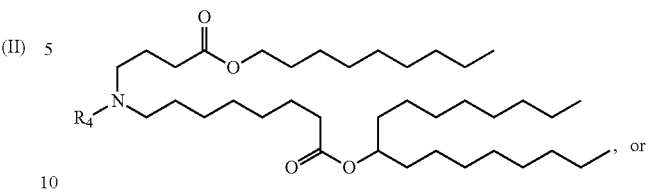

(IIc)

, or

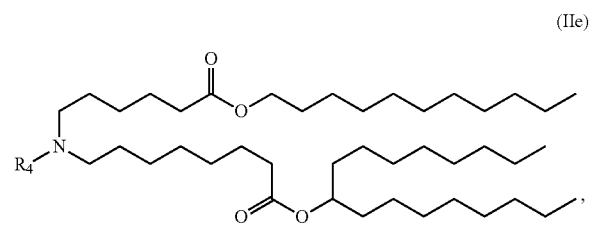

(IIe)

or a salt or isomer thereof, wherein $R_4$ is as described herein.

In some embodiments, a subset of compounds of Formula (I) includes those of Formula (IId):

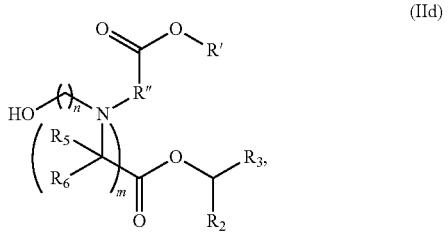

(IId)

or a salt or isomer thereof, wherein n is 2, 3, or 4; and m, R', R", and $R_2$ through $R_6$ are as described herein. For example, each of $R_2$ and $R_3$ may be independently selected from the group consisting of $C_{5-14}$ alkyl and $C_{5-14}$ alkenyl.

In some embodiments, the compound of Formula (I) is selected from the group consisting of:

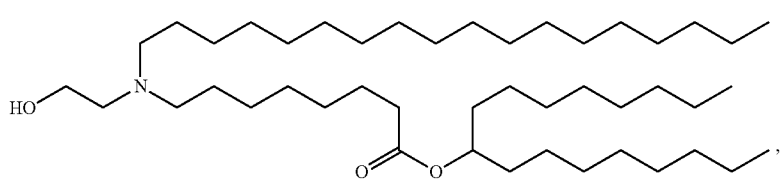

(Compound 1)

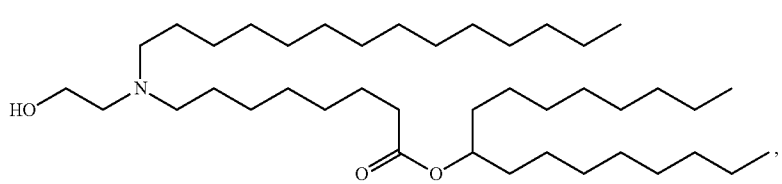

(Compound 2)

-continued
(Compound 3)
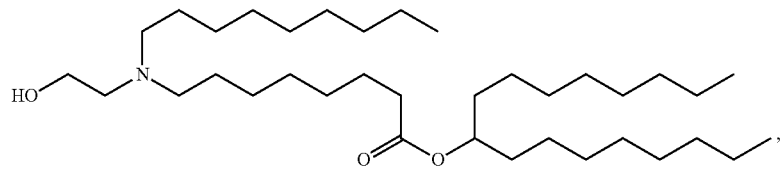
(Compound 4)
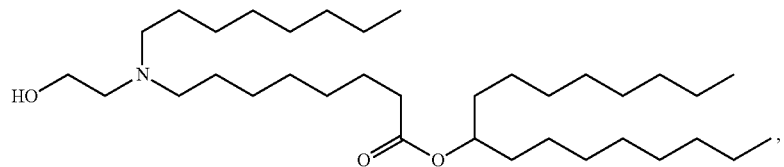
(Compound 5)
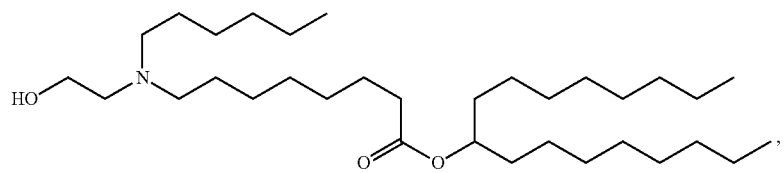
(Compound 6)
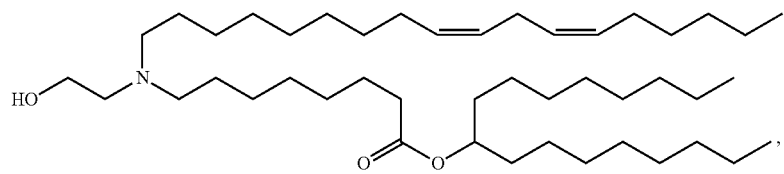
(Compound 7)
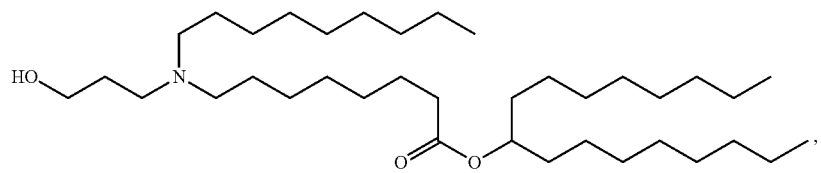
(Compound 8)
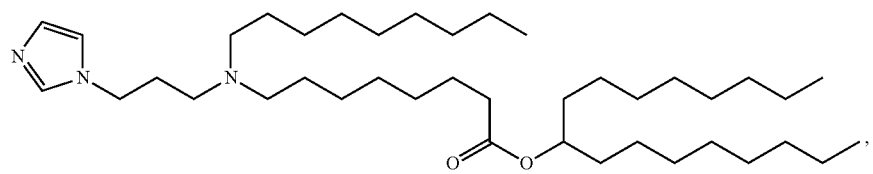
(Compound 9)
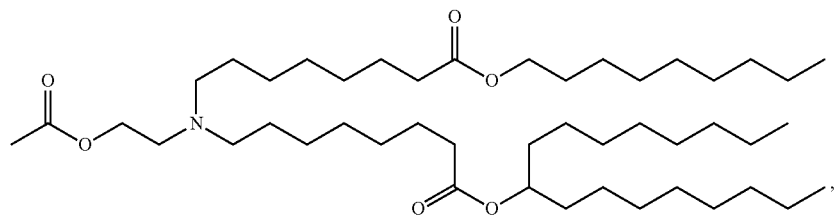
(Compound 10)
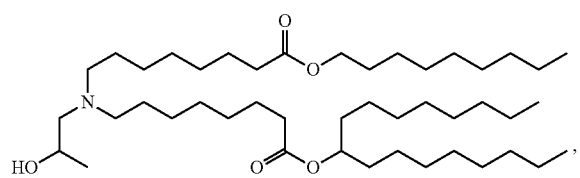
(Compound 11)
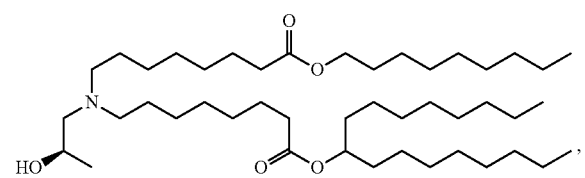

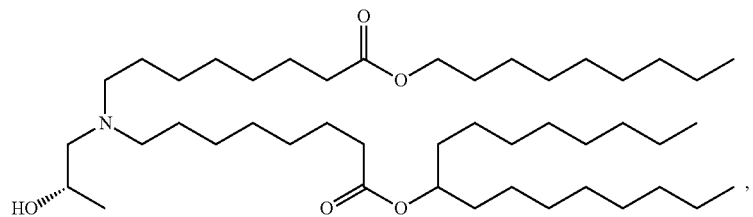
(Compound 12)
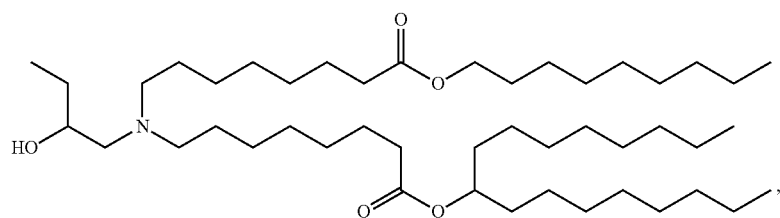
(Compound 13)
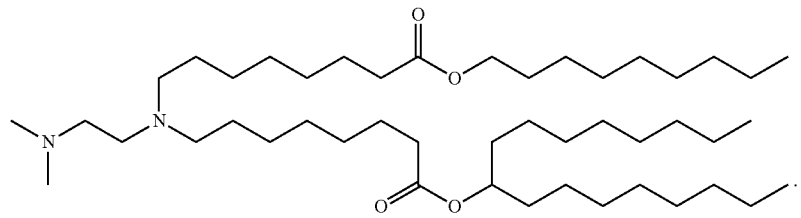
(Compound 14)
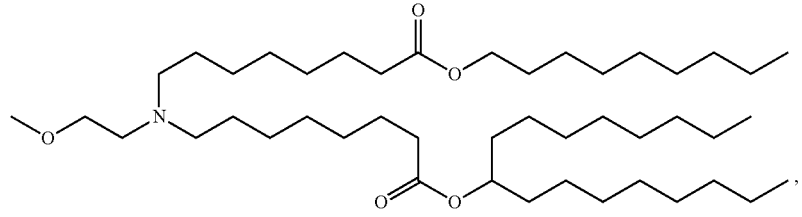
(Compound 15)
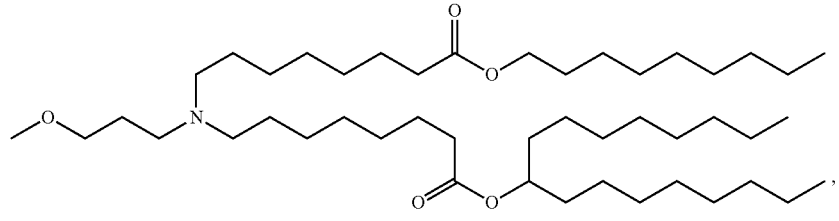
(Compound 16)
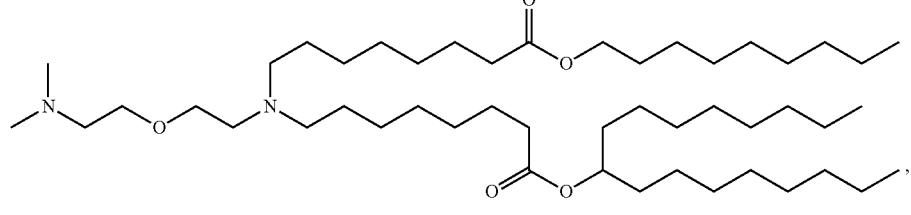
(Compound 17)
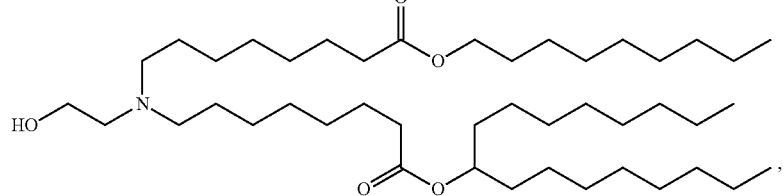
(Compound 18)

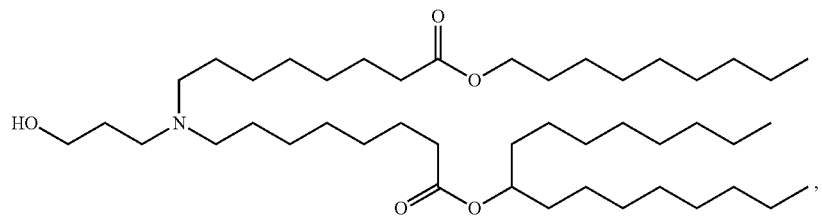
(Compound 19)
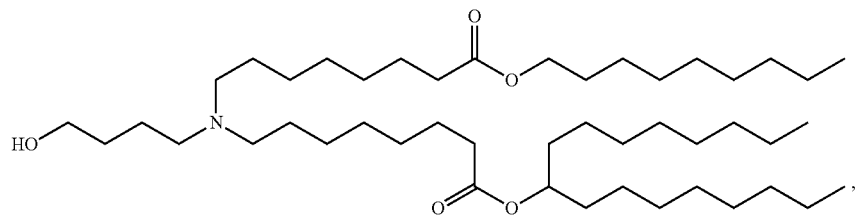
(Compound 20)
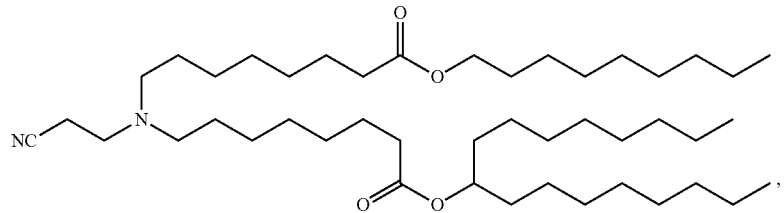
(Compound 21)
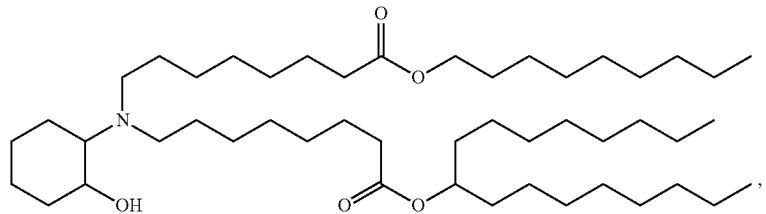
(Compound 22)
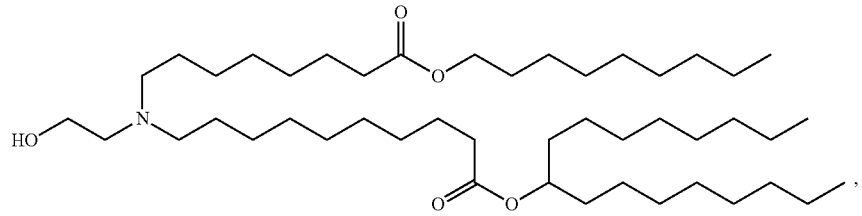
(Compound 23)
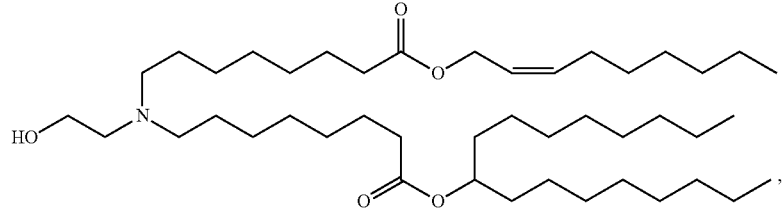
(Compound 24)
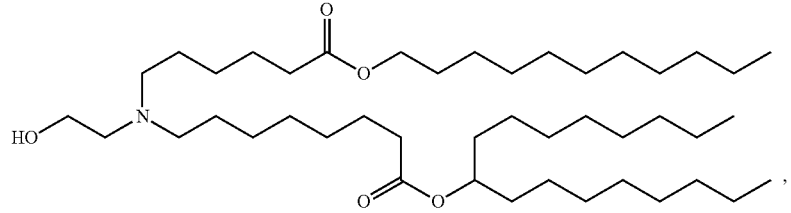
(Compound 25)

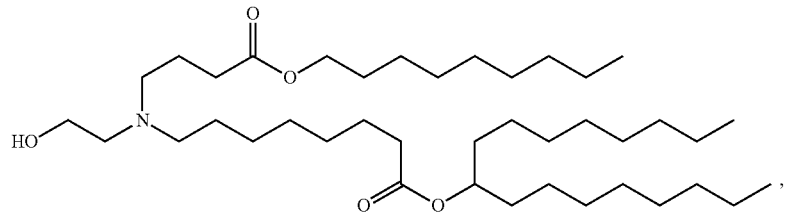
(Compound 26)
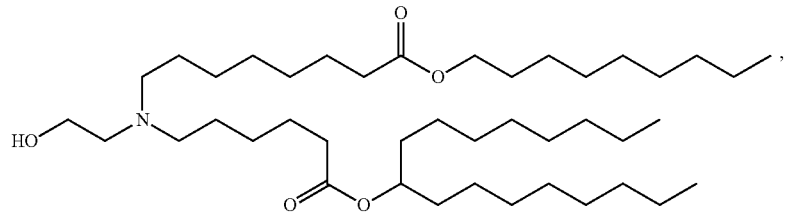
(Compound 27)
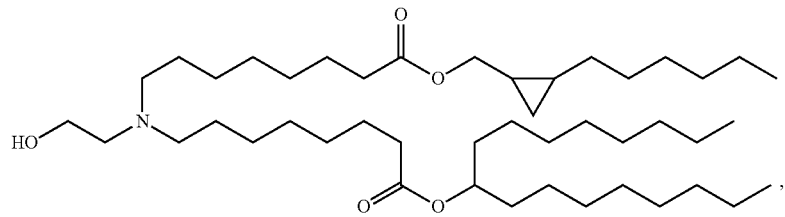
(Compound 28)
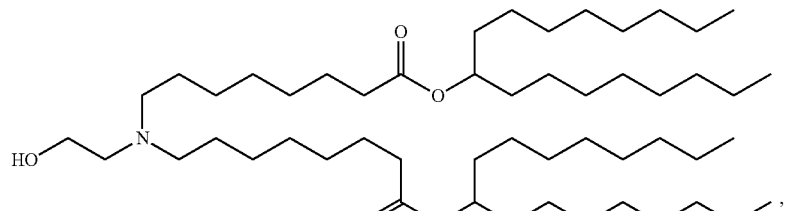
(Compound 29)
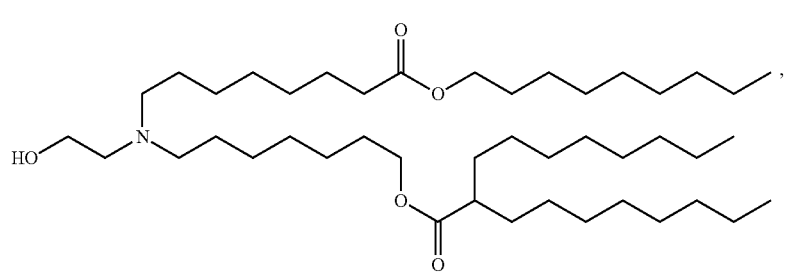
(Compound 30)
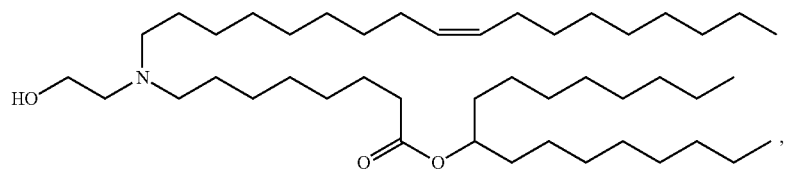
(Compound 31)
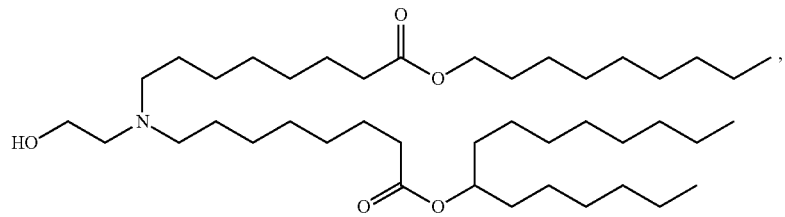
(Compound 32)

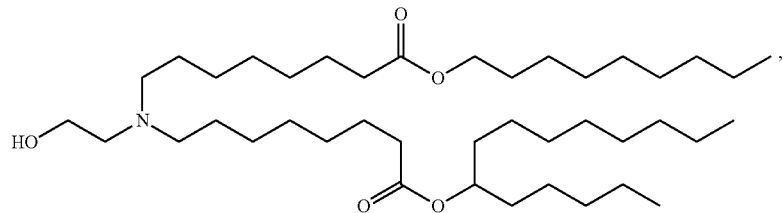
(Compound 33)
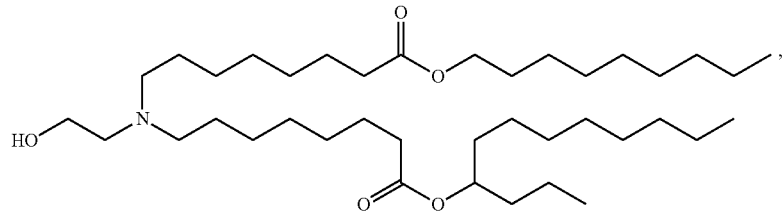
(Compound 34)
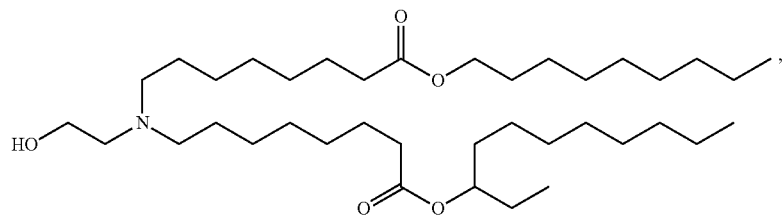
(Compound 35)
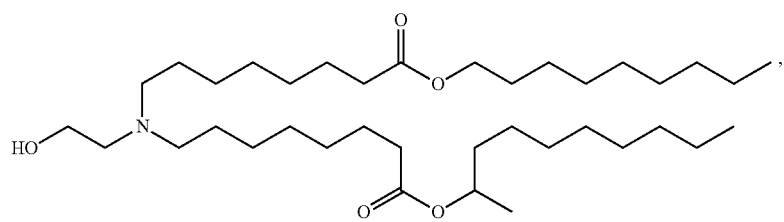
(Compound 36)
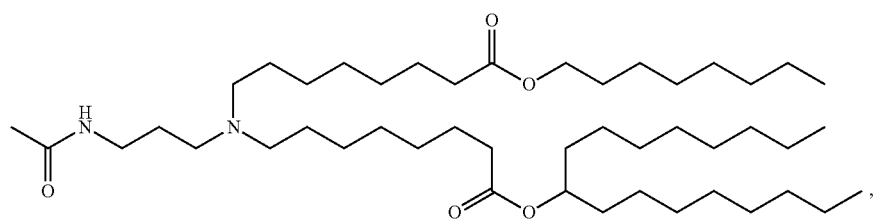
(Compound 37)
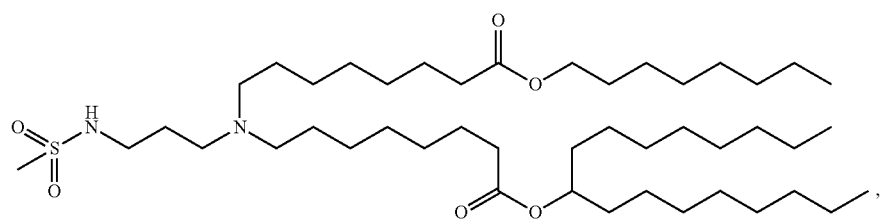
(Compound 38)
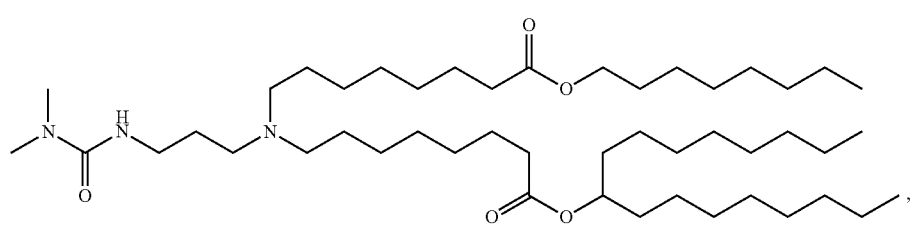
(Compound 39)

(Compound 40)
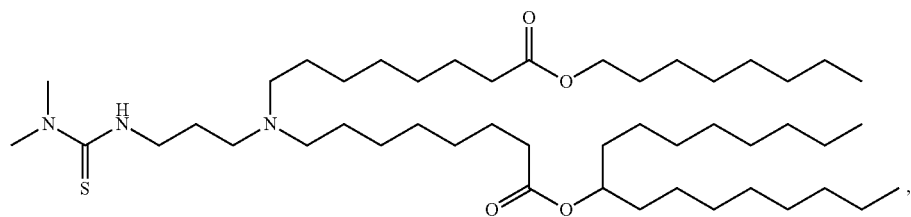
,
(Compound 41)
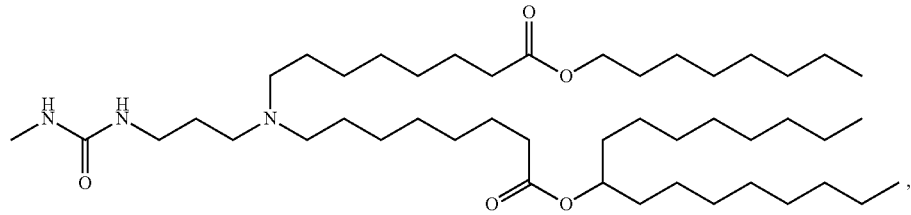
,
(Compound 42)
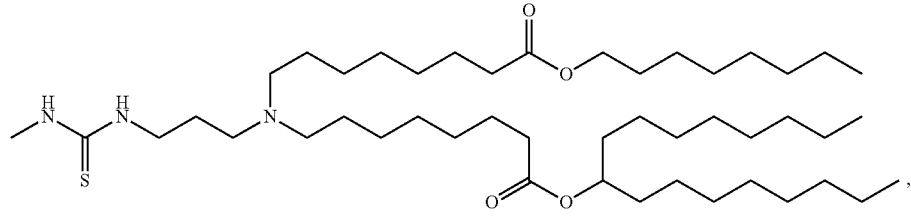
,
(Compound 43)
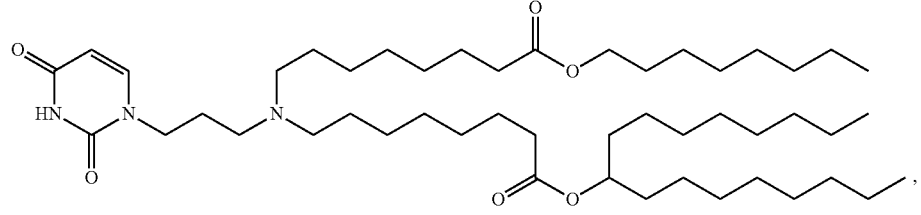
,
(Compound 44)
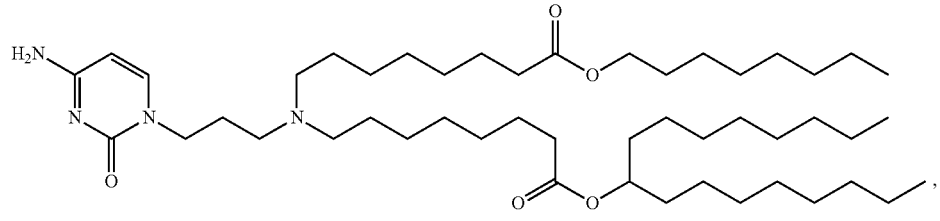
,
(Compound 45)
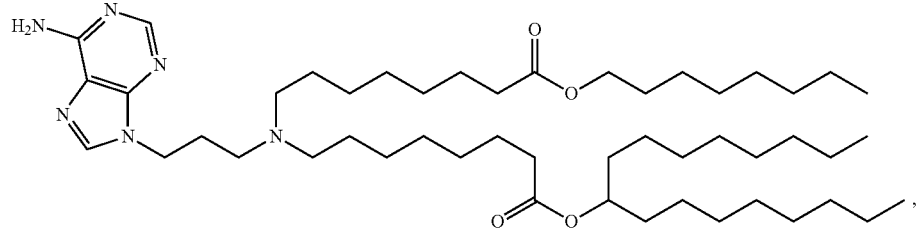
,
(Compound 46)
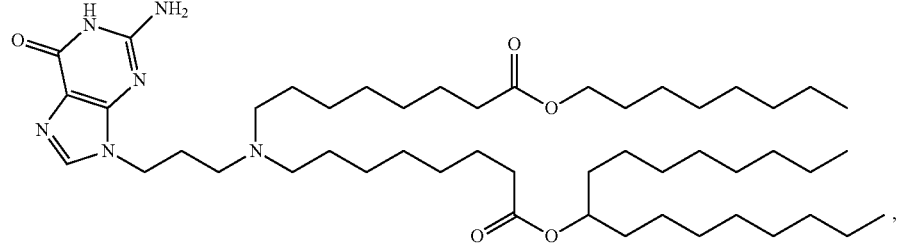
,

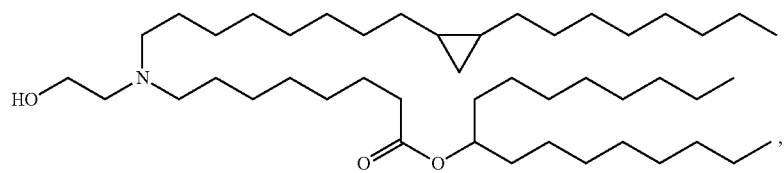
(Compound 47)
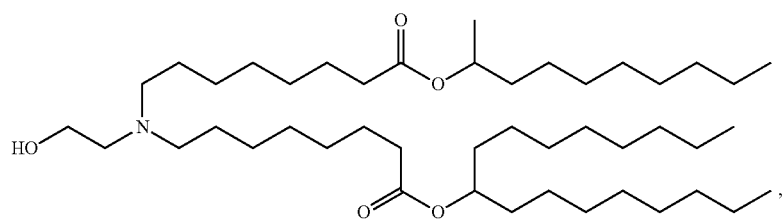
(Compound 48)
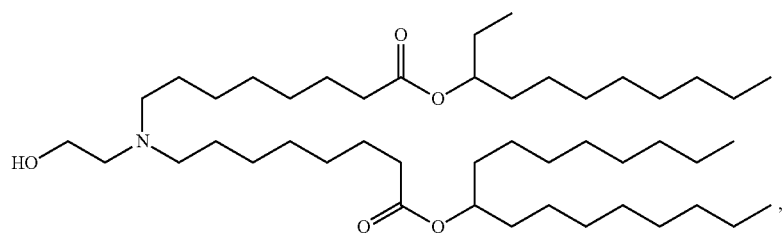
(Compound 49)
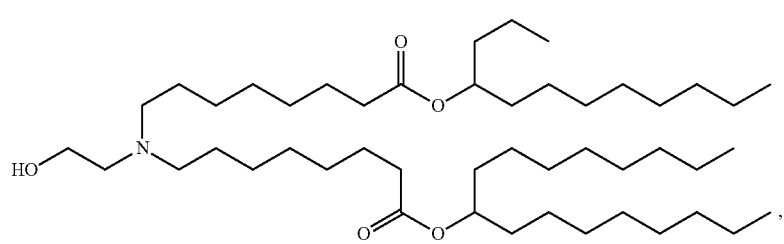
(Compound 50)
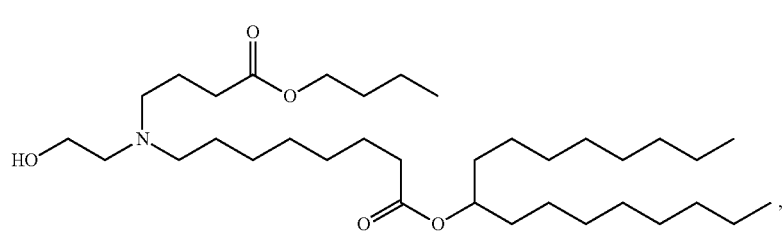
(Compound 51)
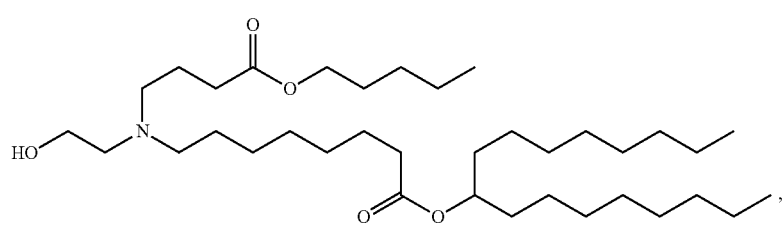
(Compound 52)
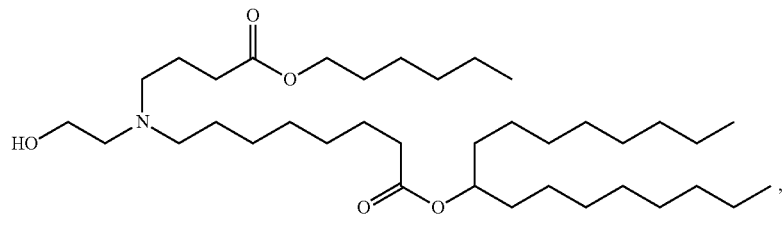
(Compound 53)

-continued
(Compound 54)
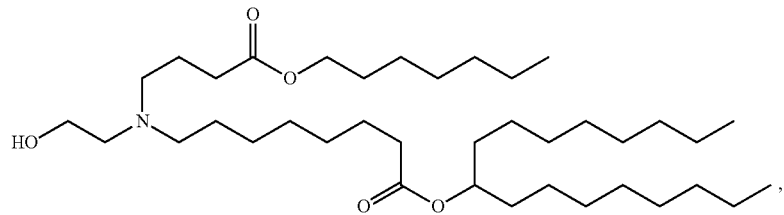
(Compound 55)
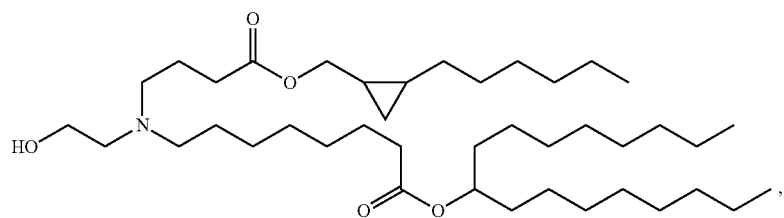
(Compound 56)
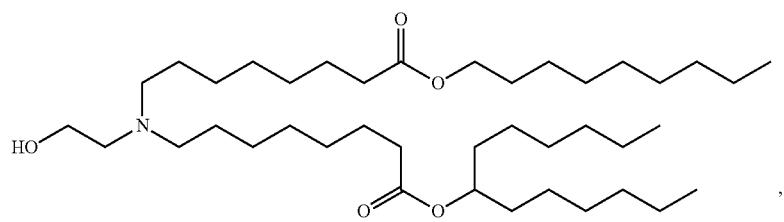
(Compound 57)
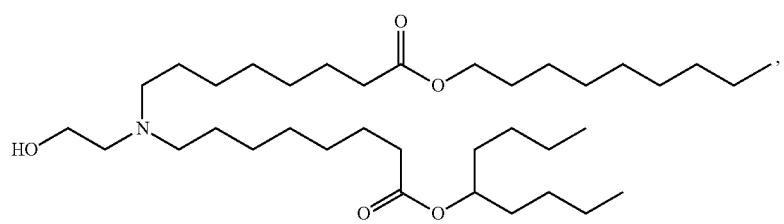
(Compound 58)
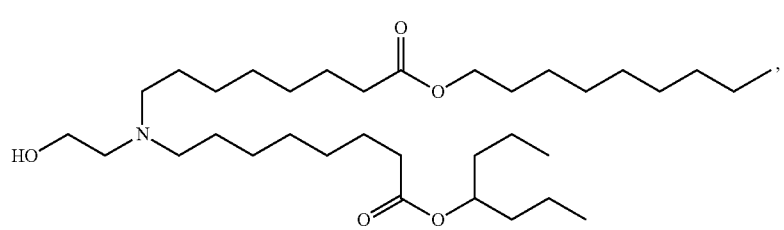
(Compound 59)
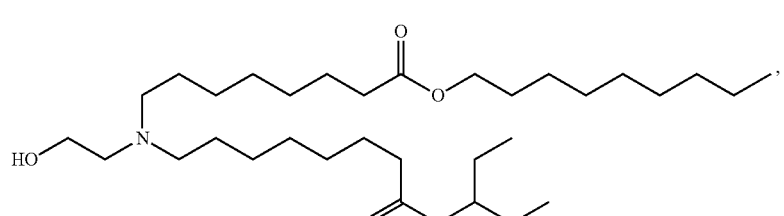
(Compound 60)
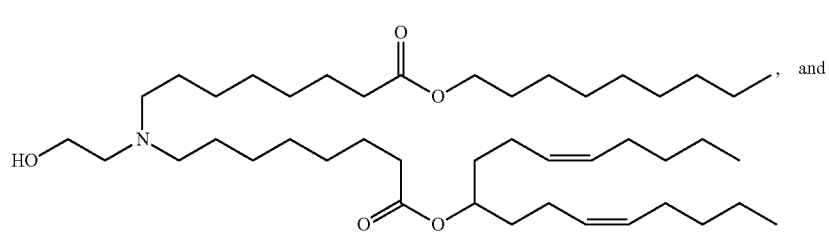

(Compound 61)
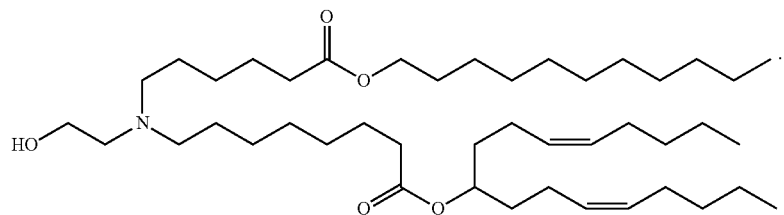
In further embodiments, the compound of Formula (I) is selected from the group consisting of:
(Compound 62)
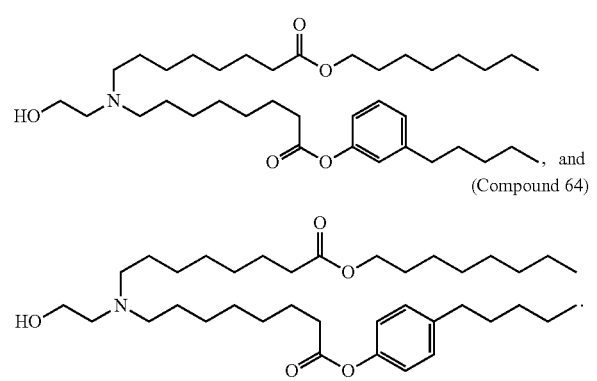
-continued
(Compound 63)
(Compound 64)
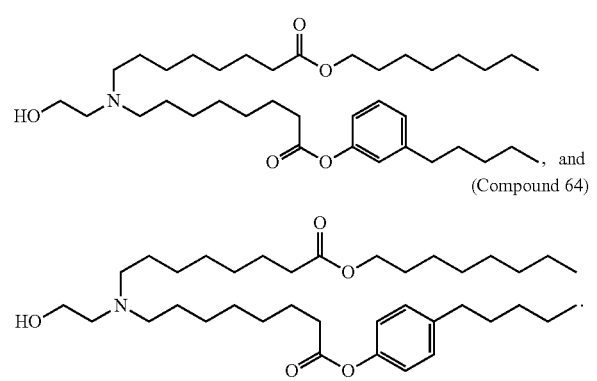
, and
In some embodiments, the compound of Formula (I) is selected from the group consisting of:
(Compound 65)
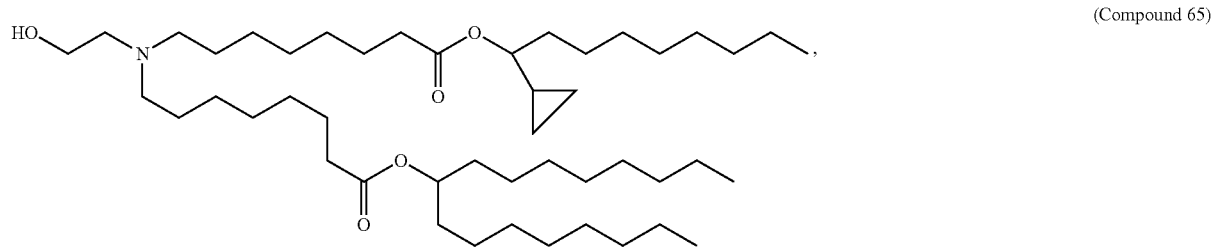
(Compound 66)
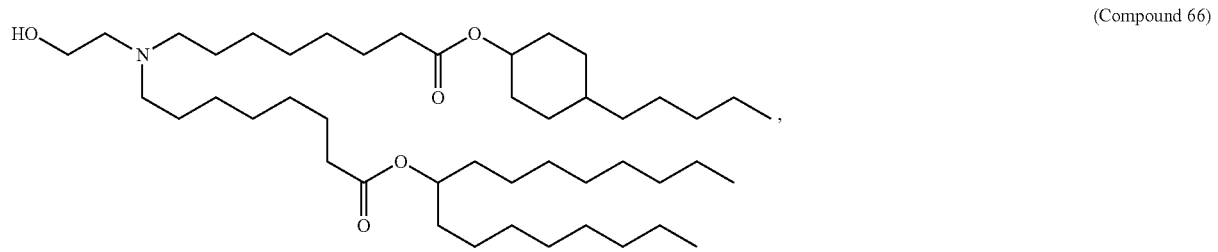
(Compound 67)
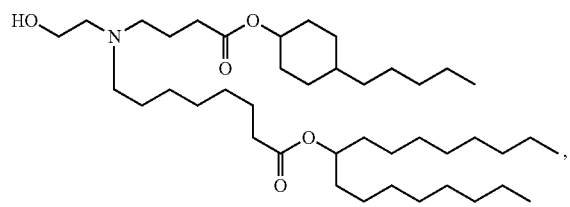
(Compound 68)
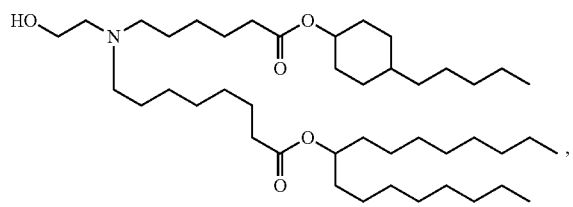

-continued
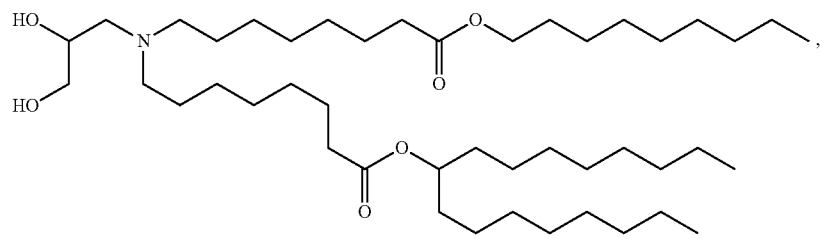
(Compound 69)
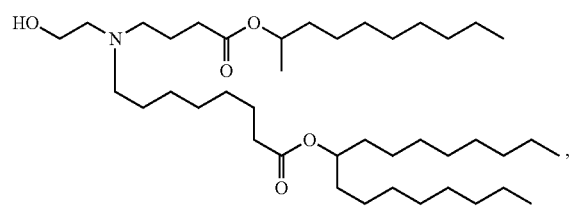
(Compound 70) (Compound 71)
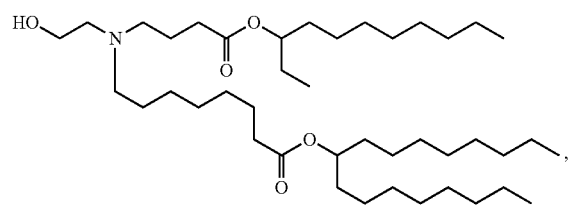
(Compound 72) (Compound 73)
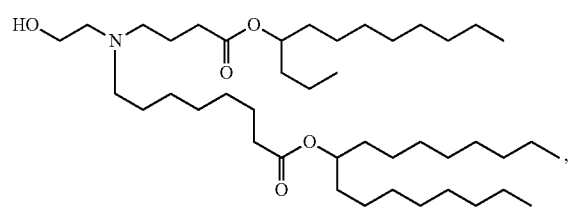
(Compound 74) (Compound 75)
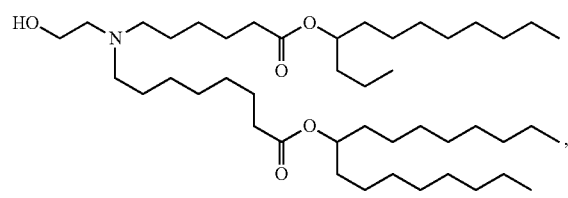
(Compound 76) (Compound 77)
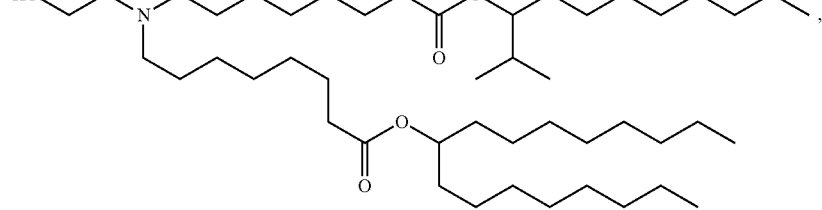
(Compound 78)
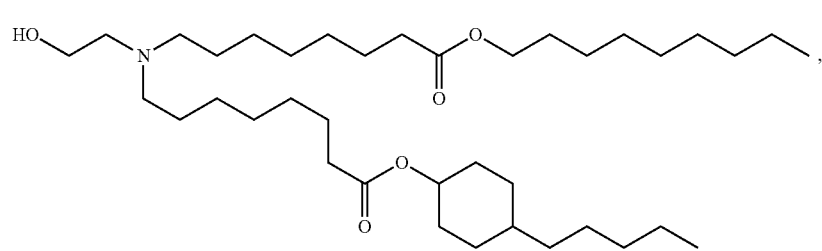
(Compound 79)

-continued
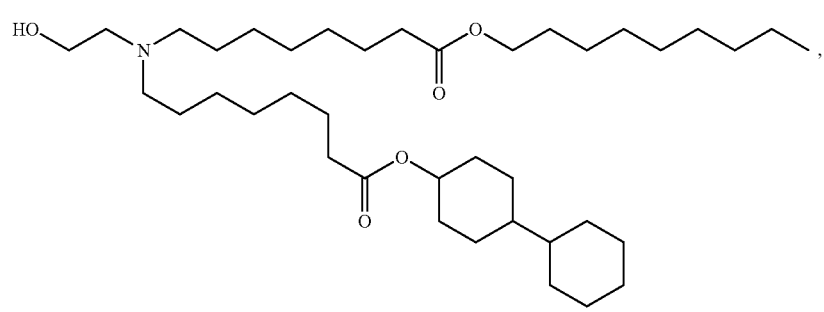
(Compound 80)
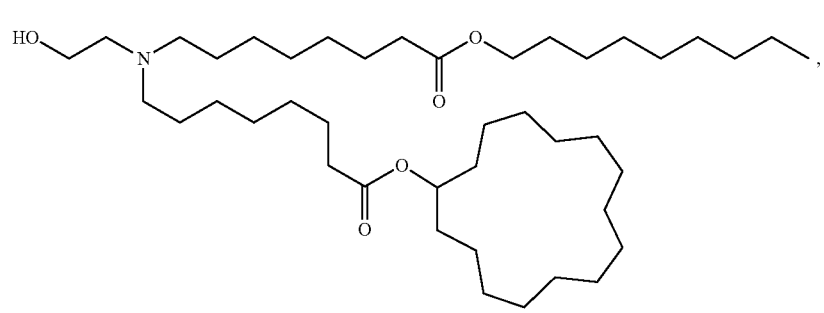
(Compound 81)
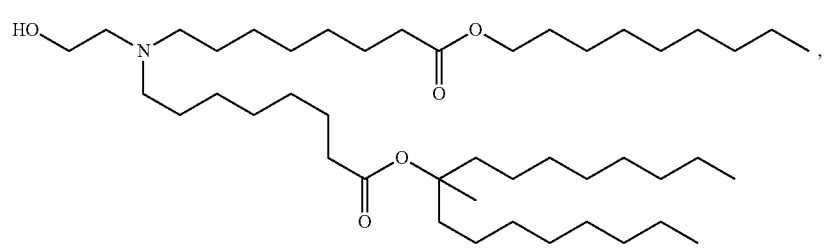
(Compound 82)
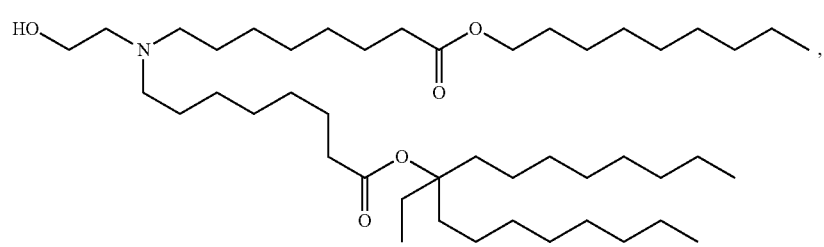
(Compound 83)
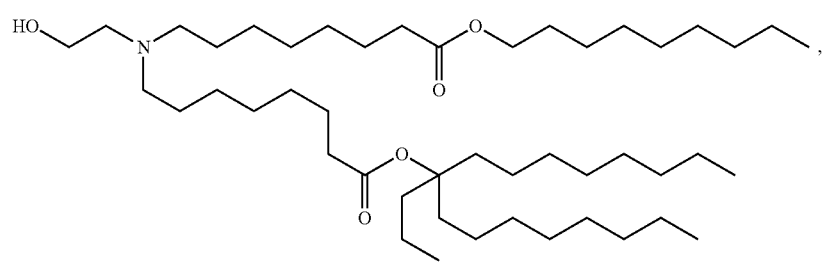
(Compound 84)
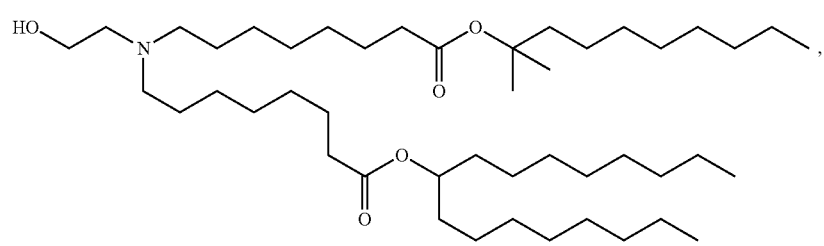
(Compound 85)

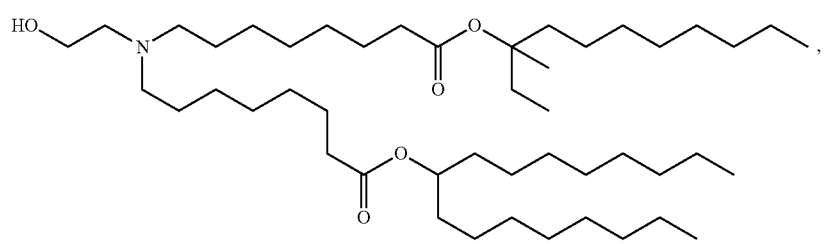
(Compound 86)
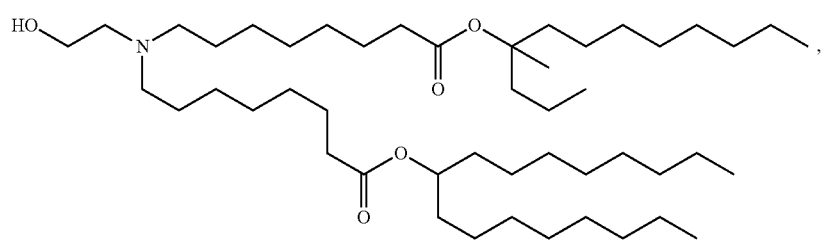
(Compound 87)
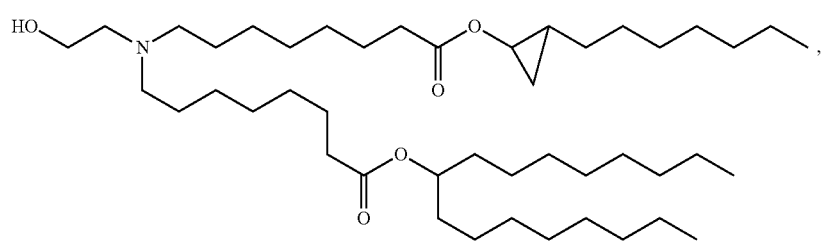
(Compound 88)
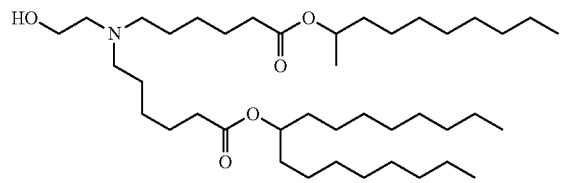
(Compound 89)
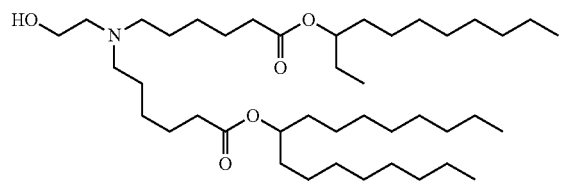
(Compound 91)
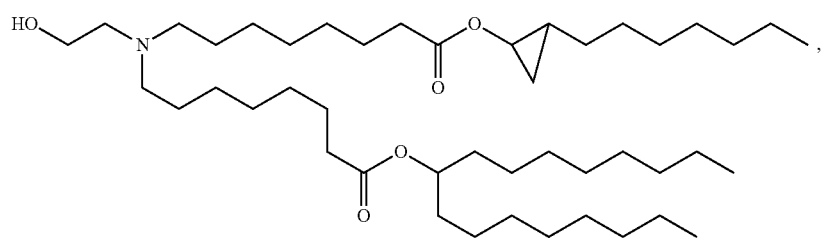
(Compound 93)
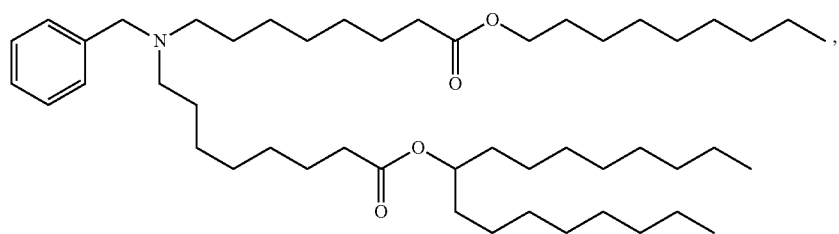
(Compound 90)
(Compound 92)
(Compound 94)

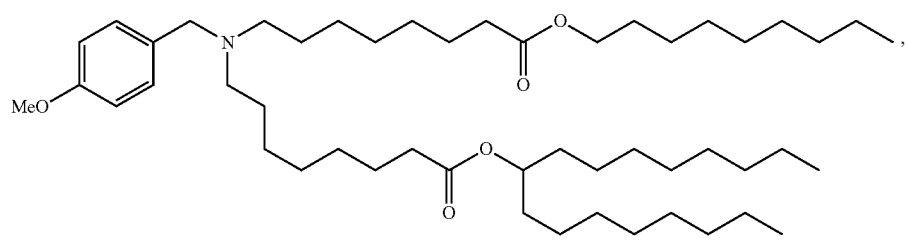
(Compound 95)
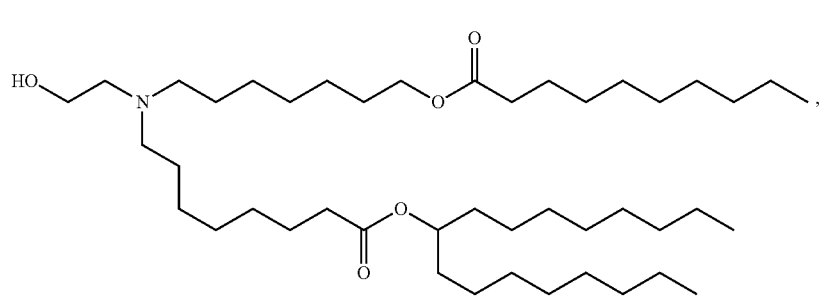
(Compound 96)
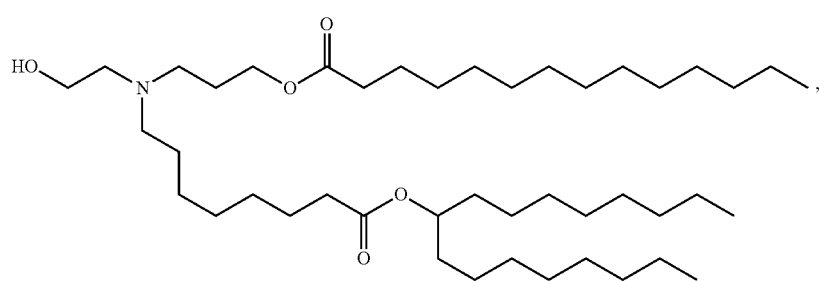
(Compound 97)
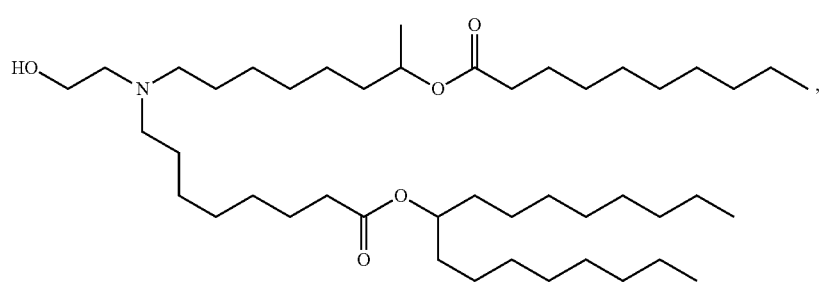
(Compound 98)
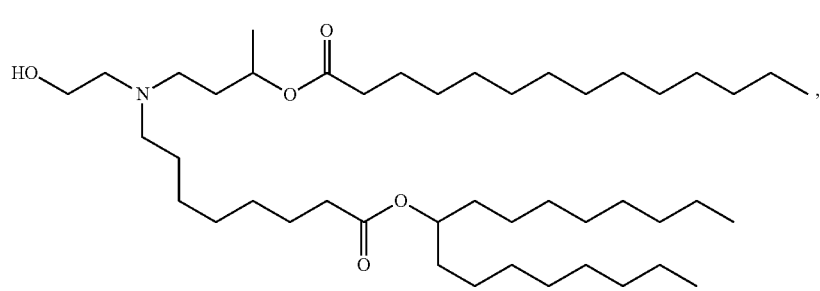
(Compound 99)

(Compound 100)
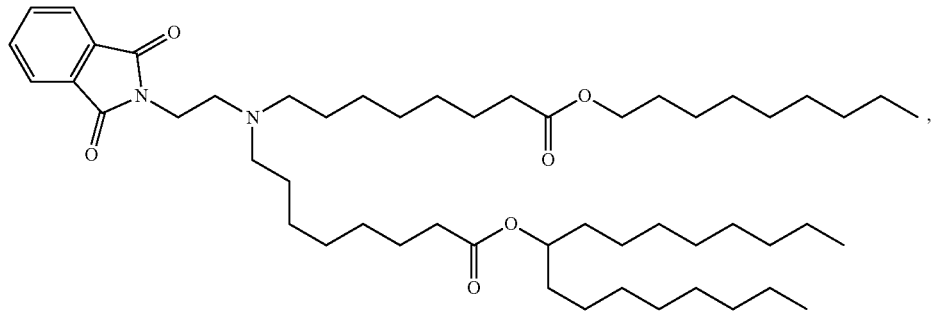
(Compound 101)
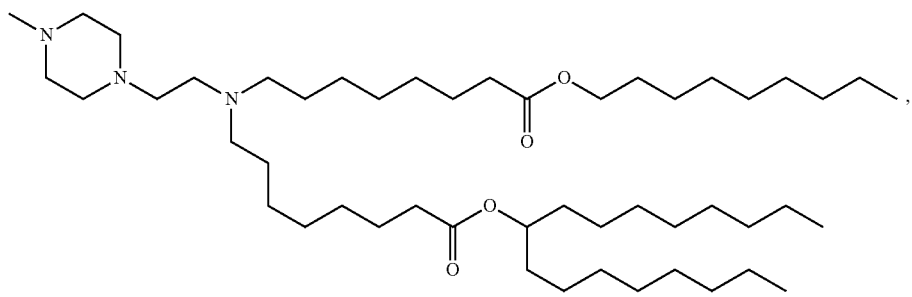
(Compound 102)
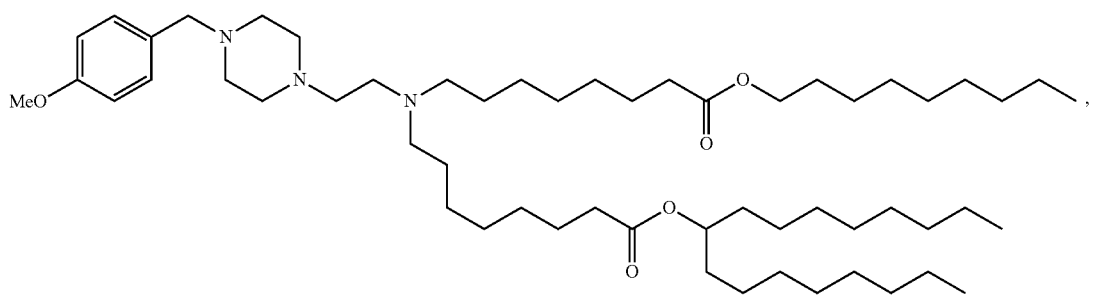
(Compound 103)
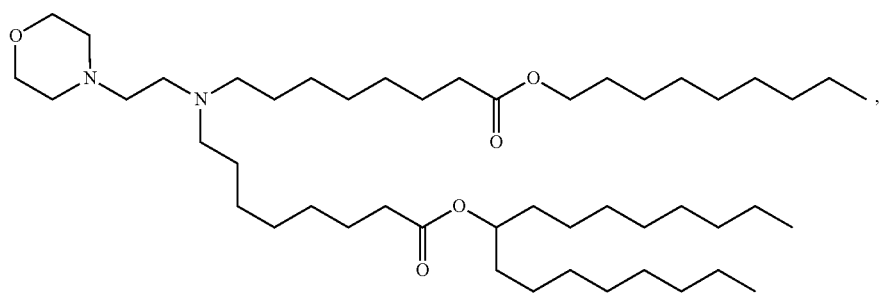
(Compound 104)
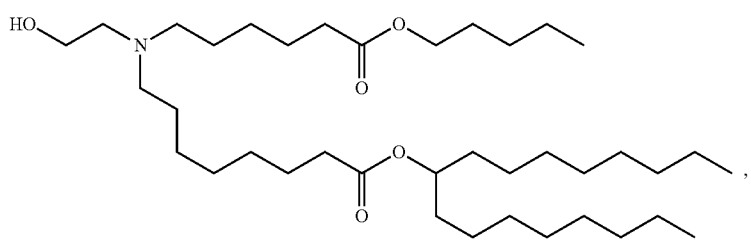

(Compound 105)
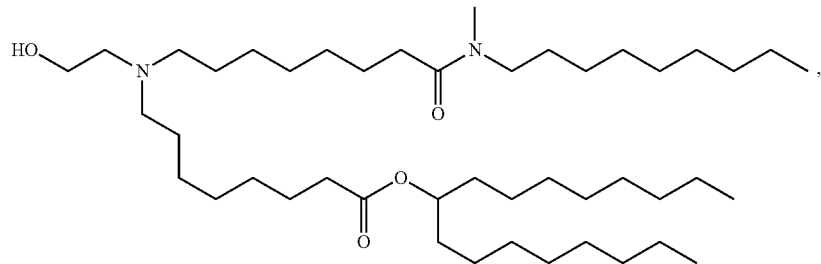
(Compound 106)
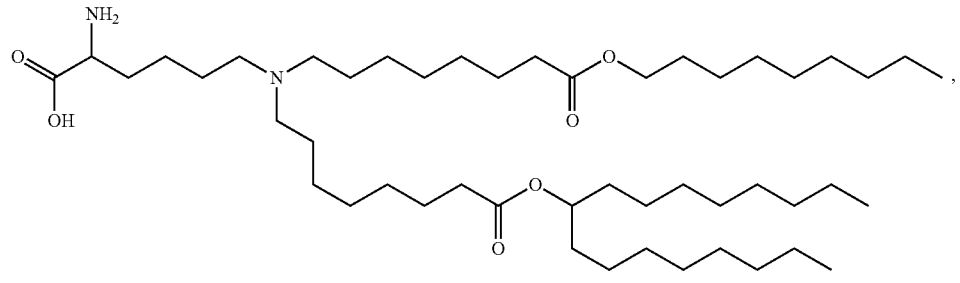
(Compound 107)
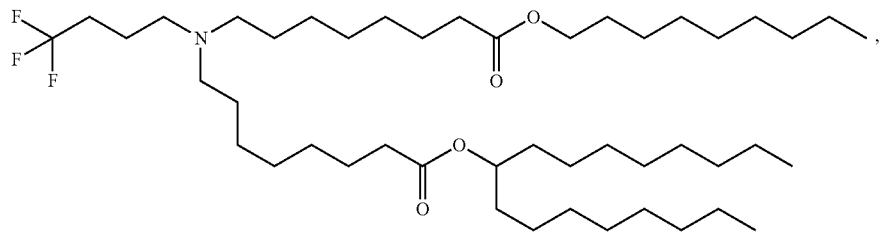
(Compound 108)
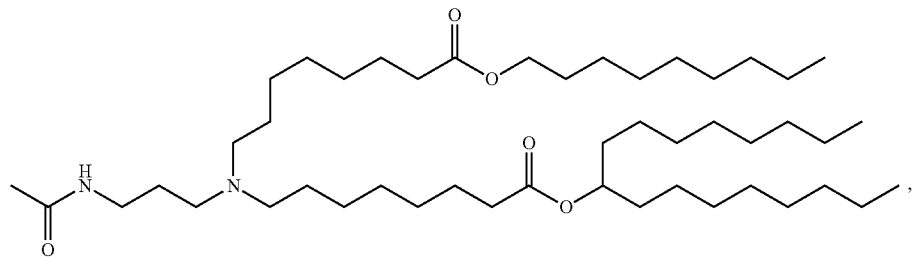
(Compound 109)
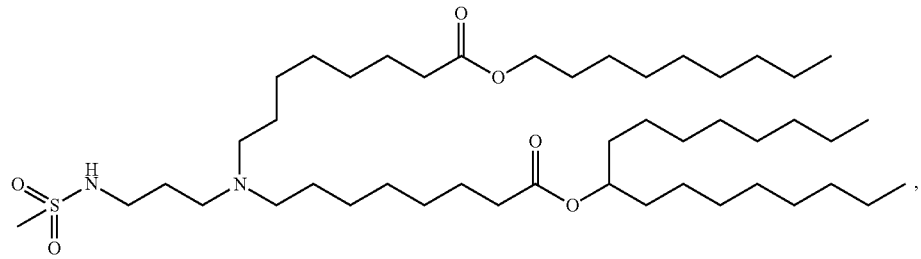
(Compound 110)
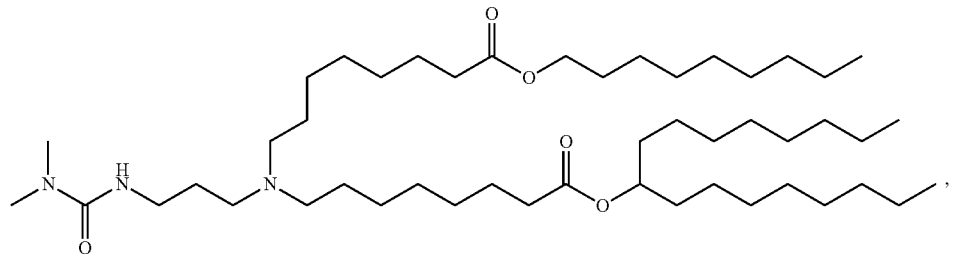

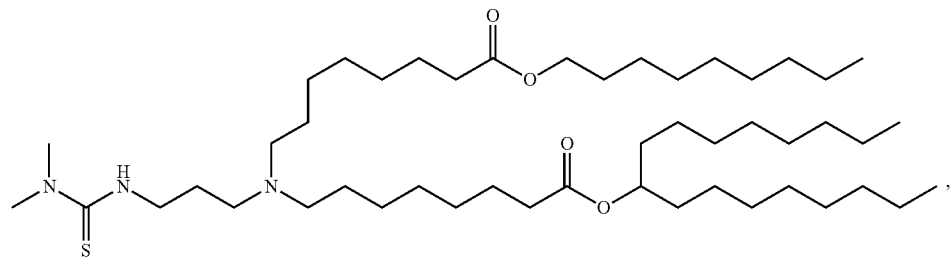
(Compound 111)
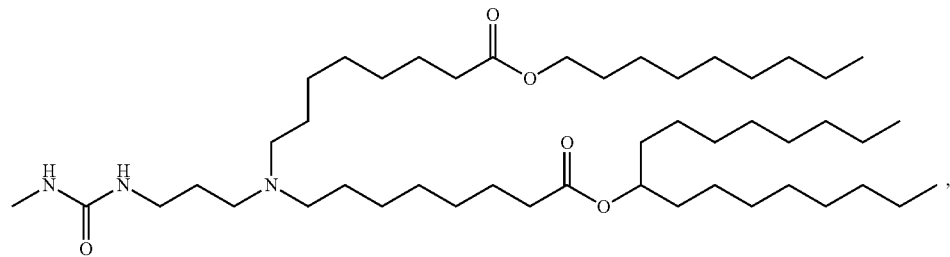
(Compound 112)
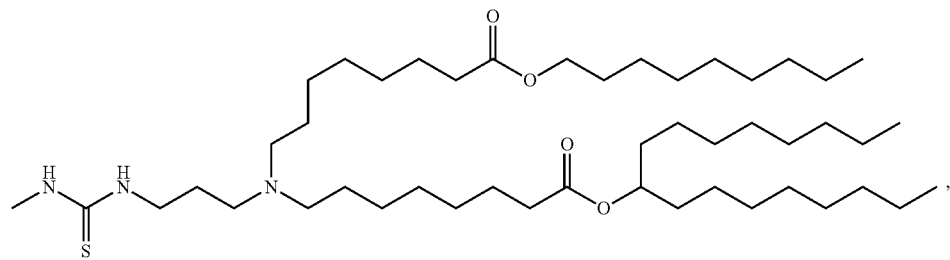
(Compound 113)
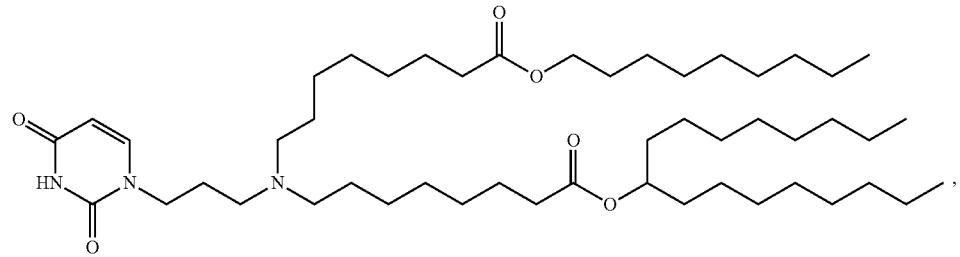
(Compound 114)
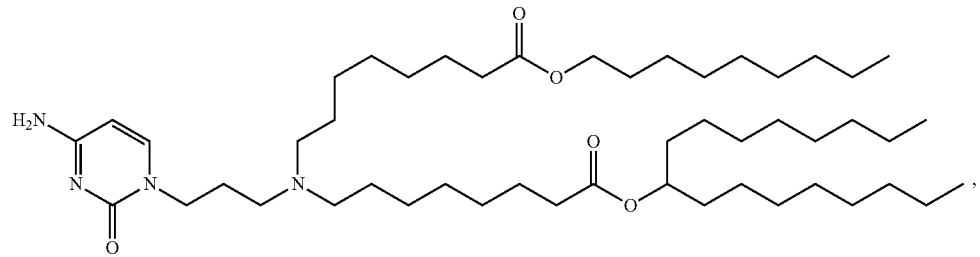
(Compound 115)
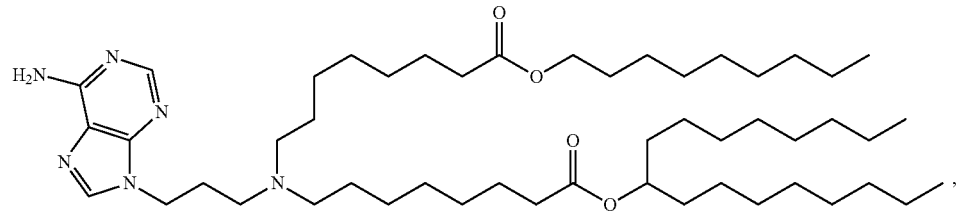
(Compound 116)

-continued
(Compound 117)
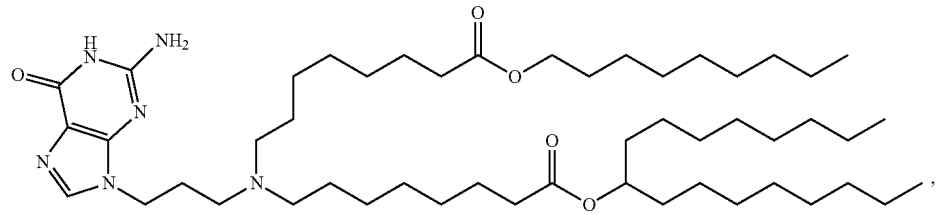
(Compound 118)
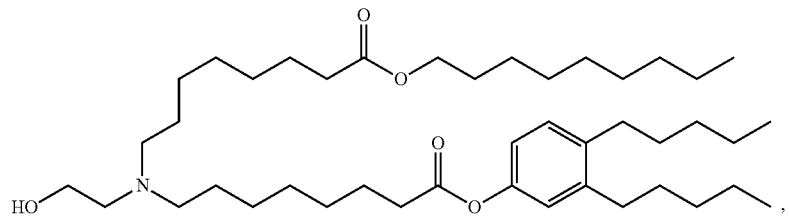
(Compound 119)
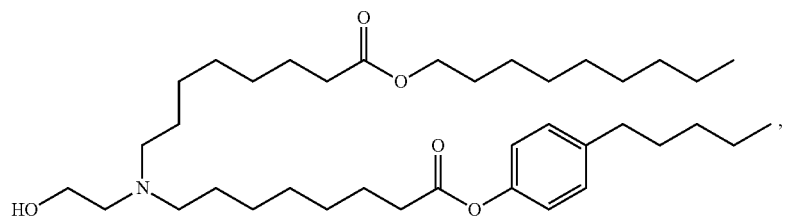
(Compound 120)
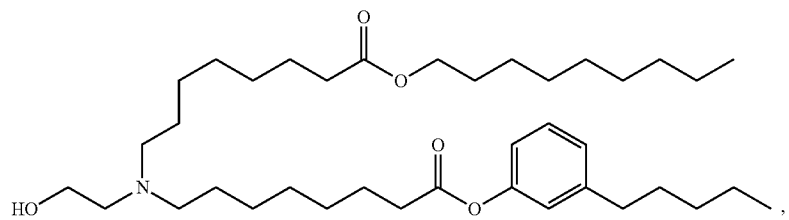
(Compound 121)
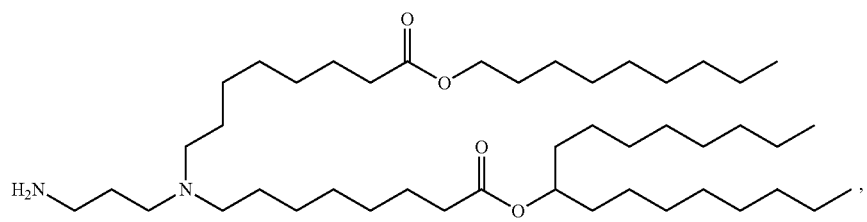
(Compound 122)
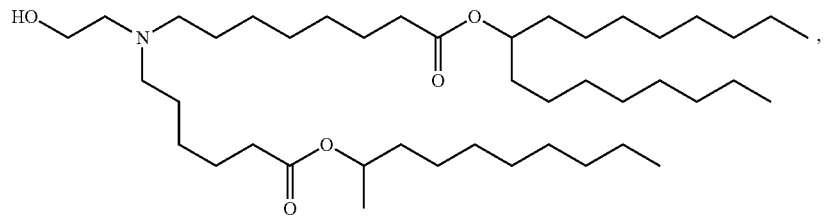
(Compound 123)
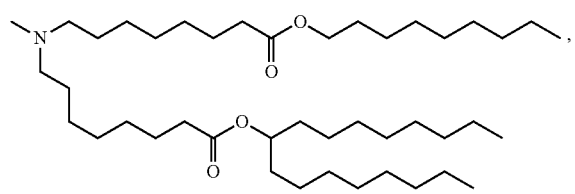
(Compound 124)
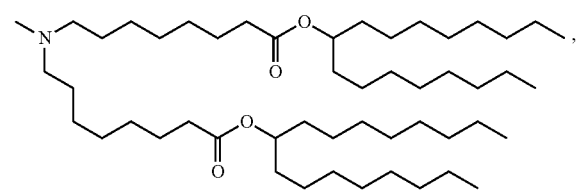

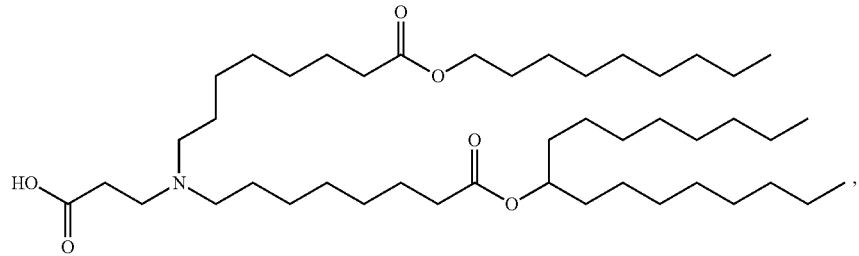
(Compound 125)
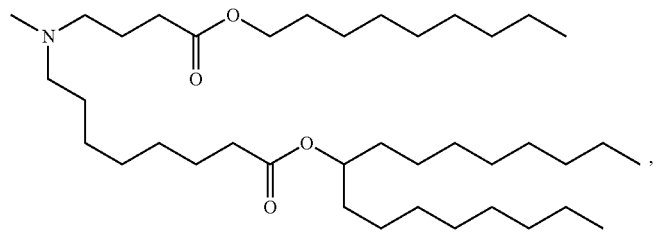
(Compound 126)
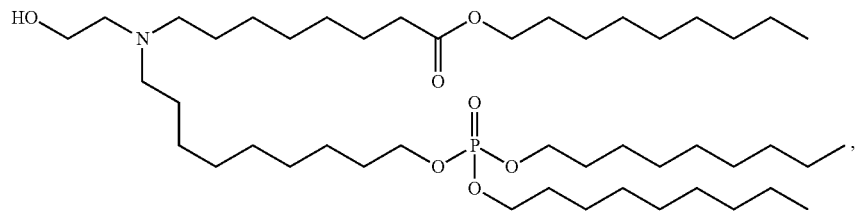
(Compound 127)
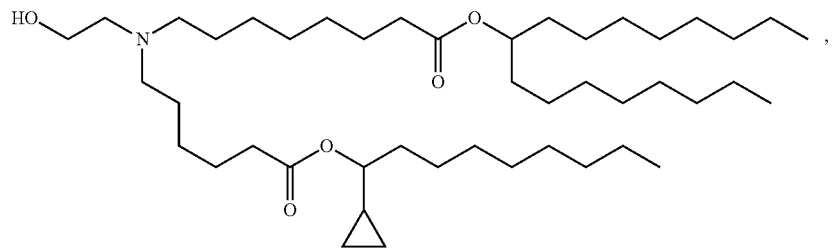
(Compound 128)
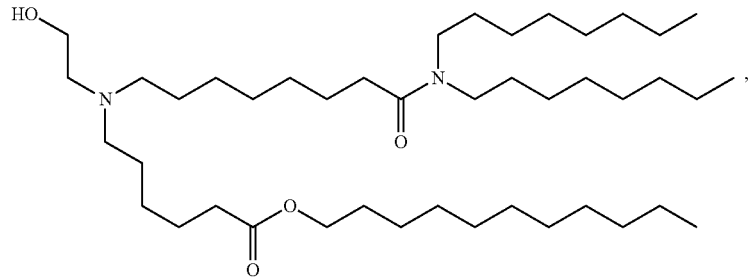
(Compound 129)
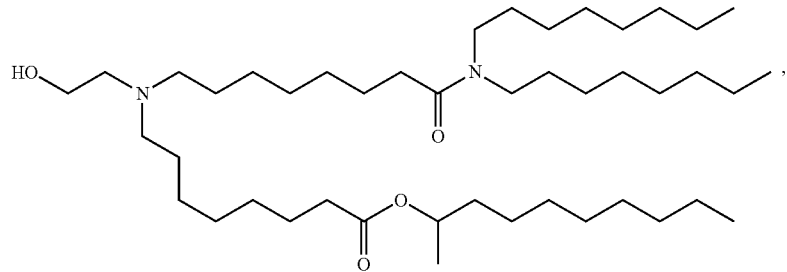
(Compound 130)

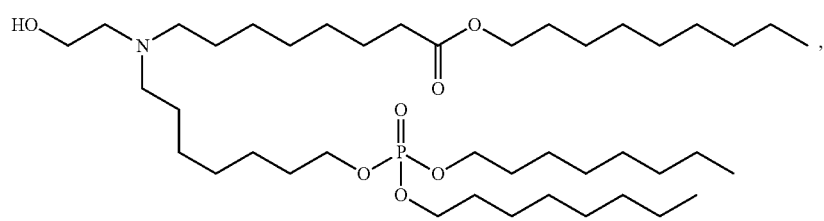
(Compound 131)
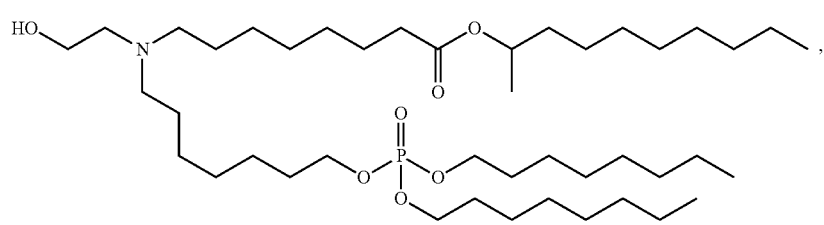
(Compound 132)
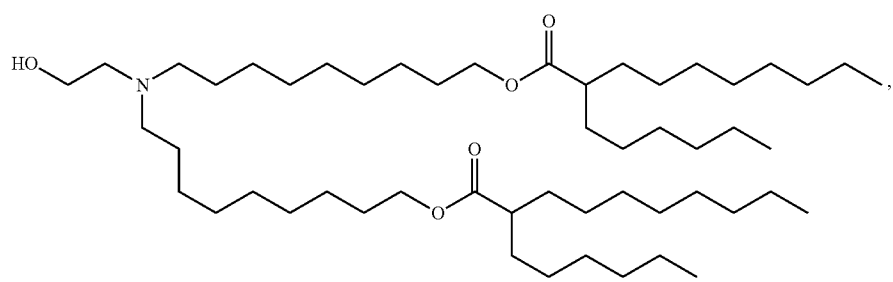
(Compound 133)
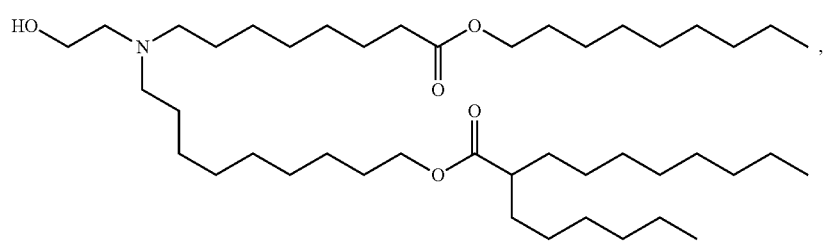
(Compound 134)
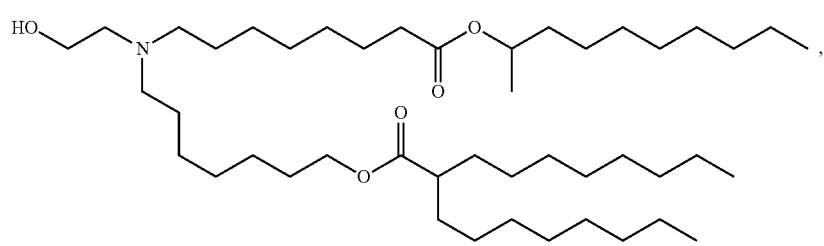
(Compound 135)
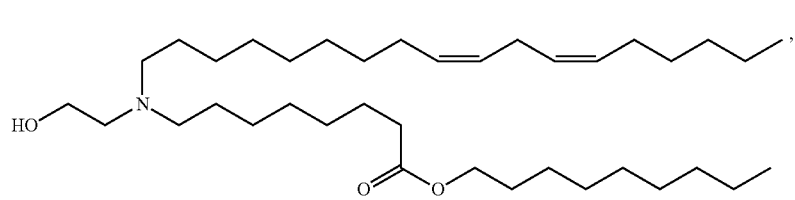
(Compound 136)
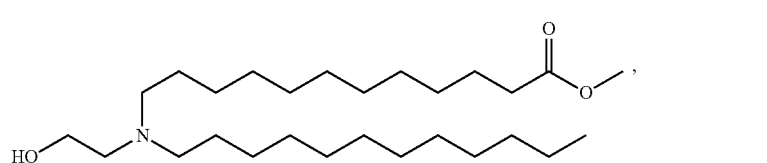
(Compound 137)

-continued
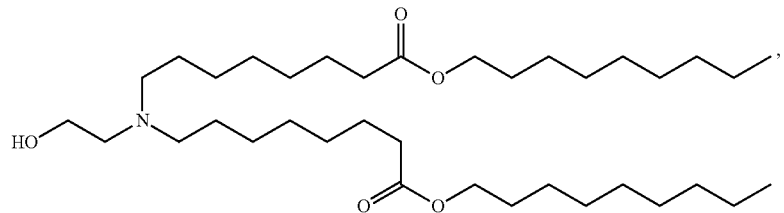
(Compound 138)
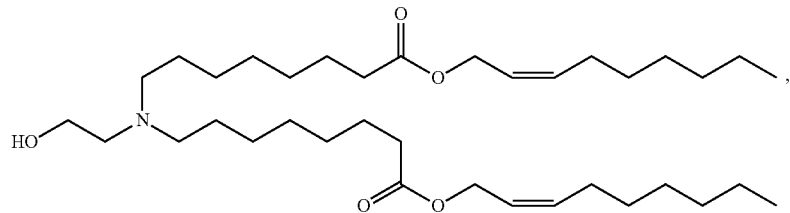
(Compound 139)
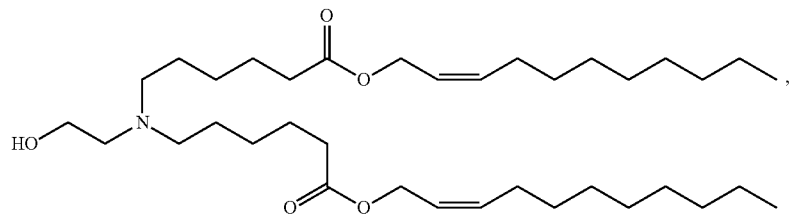
(Compound 140)
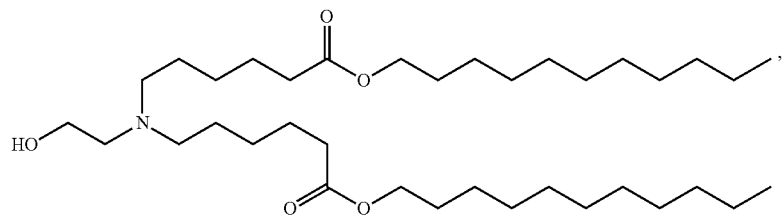
(Compound 141)
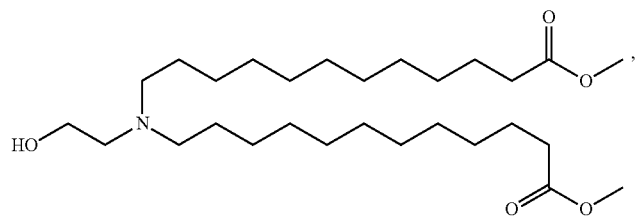
(Compound 142)
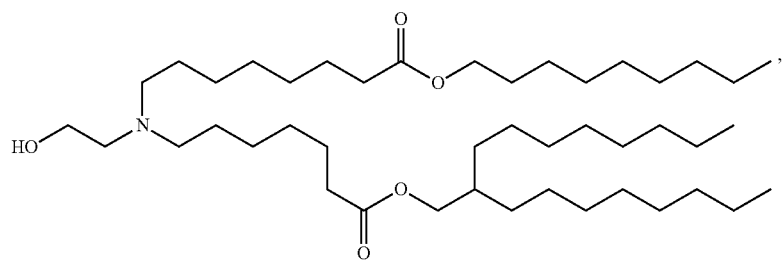
(Compound 143)

-continued
(Compound 144)
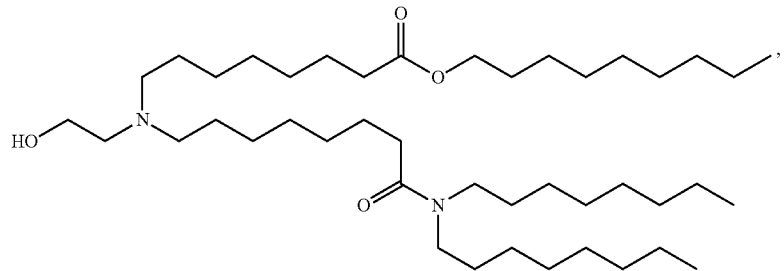
(Compound 145)
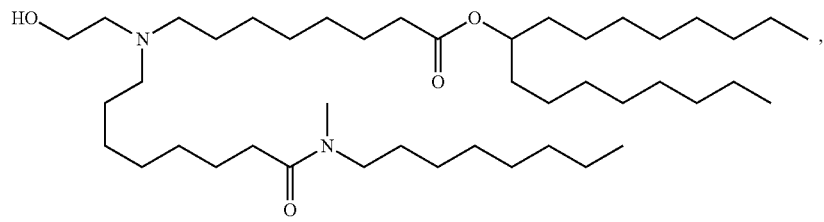
(Compound 146)
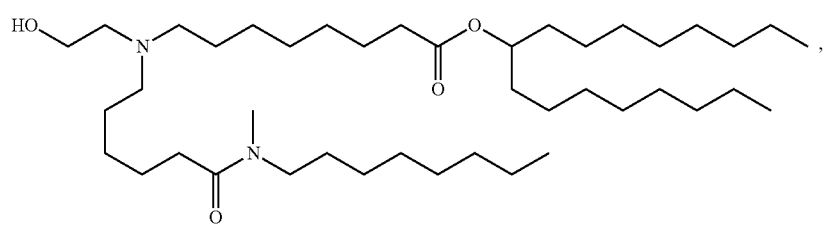
(Compound 147)
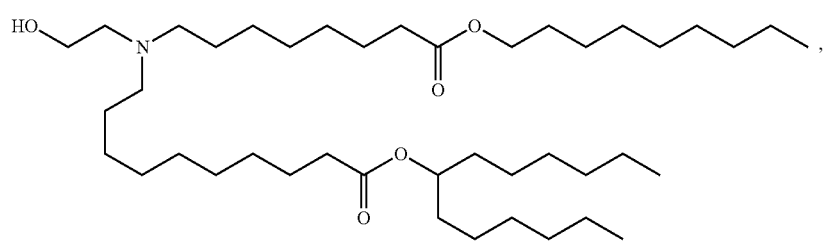
(Compound 148)
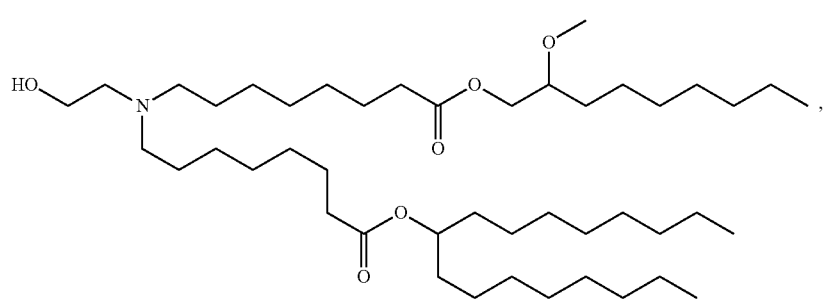
(Compound 149)          (Compound 150)
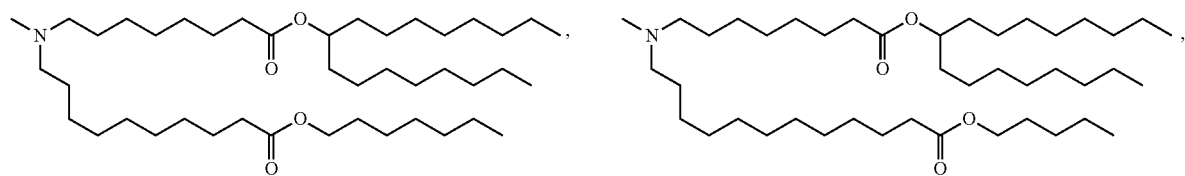

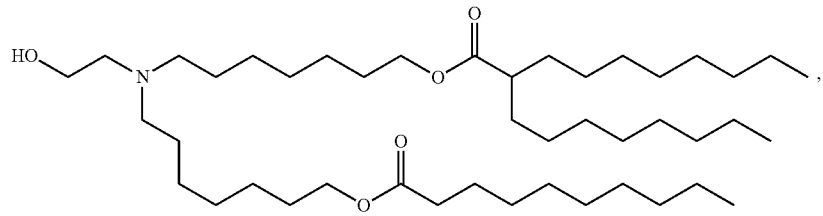
(Compound 151)
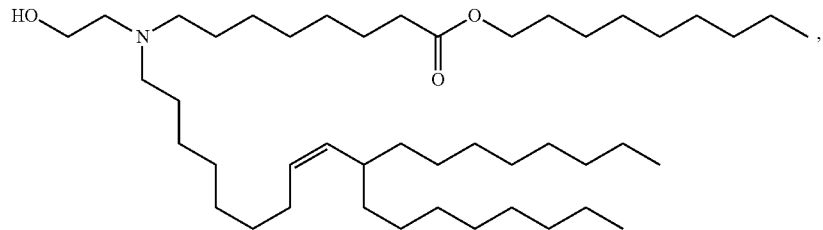
(Compound 152)
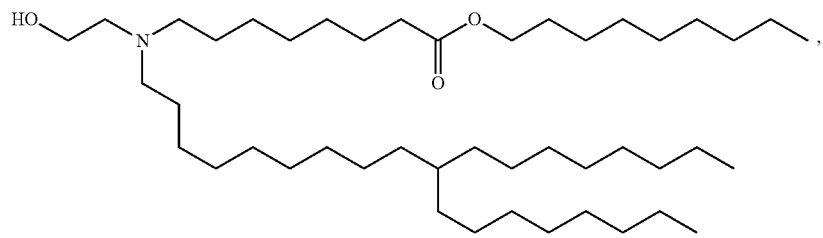
(Compound 153)
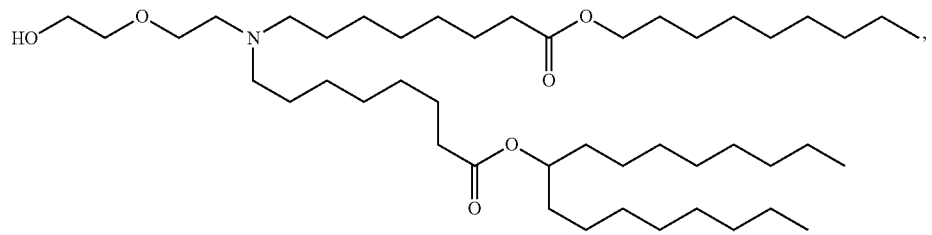
(Compound 154)
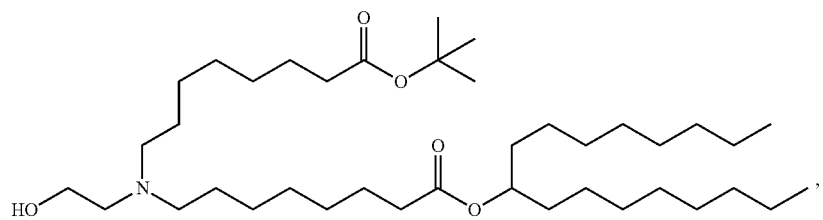
(Compound 155)
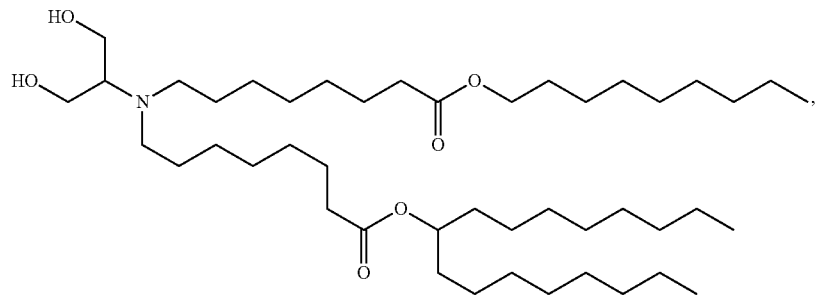
(Compound 156)

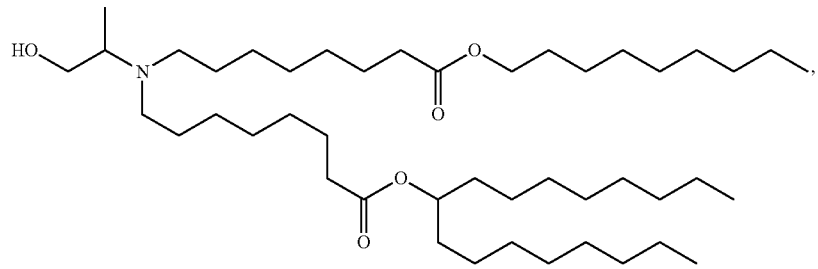
(Compound 157)
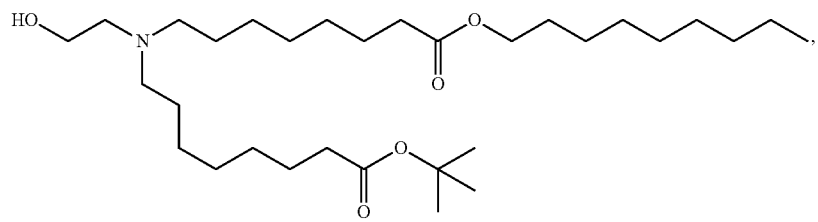
(Compound 158)
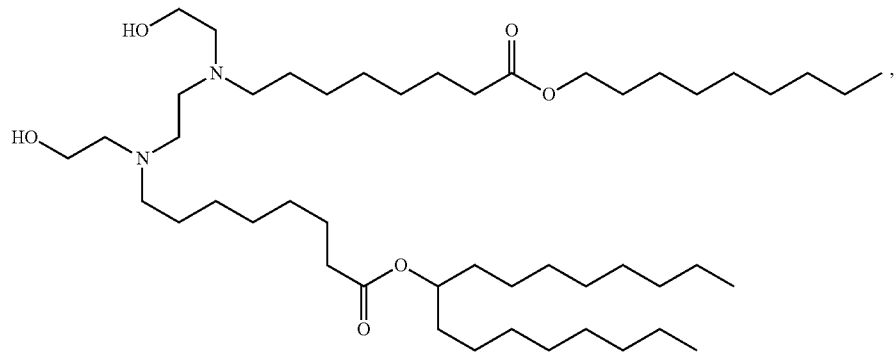
(Compound 159)
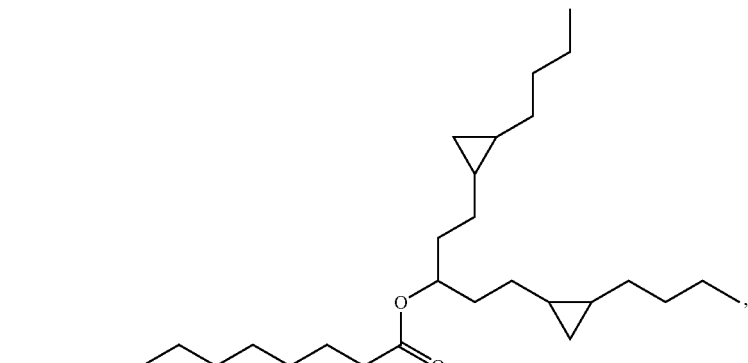
(Compound 160)
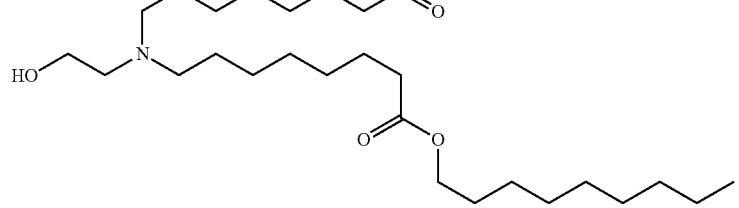
(Compound 161)
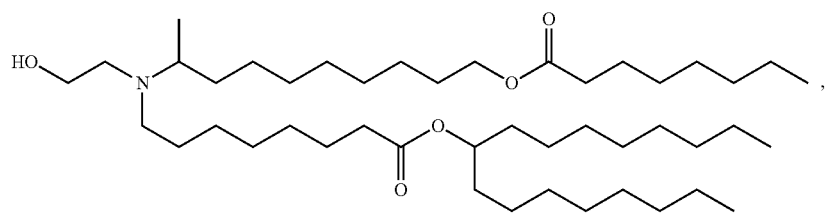

(Compound 162)
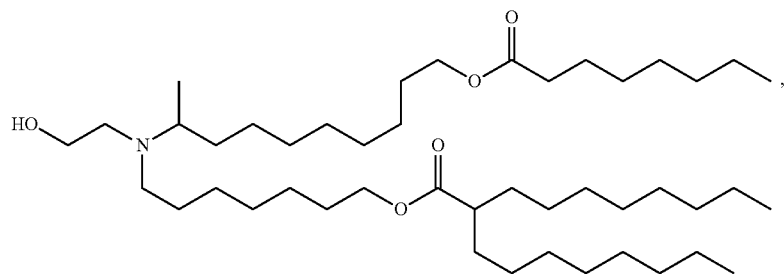
(Compound 163)
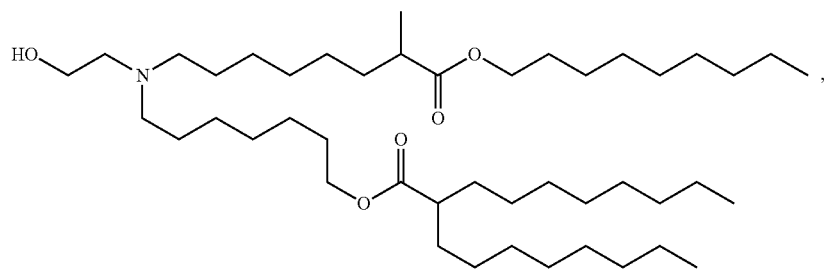
(Compound 164)
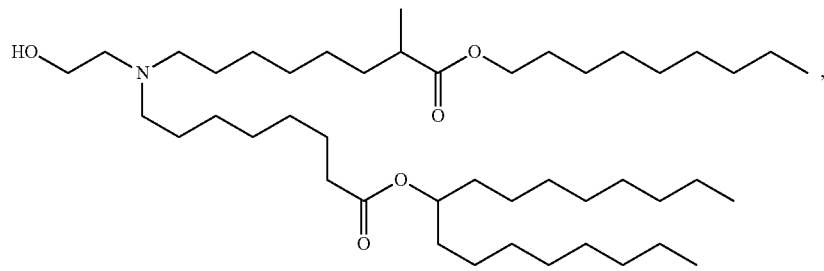
(Compound 165)
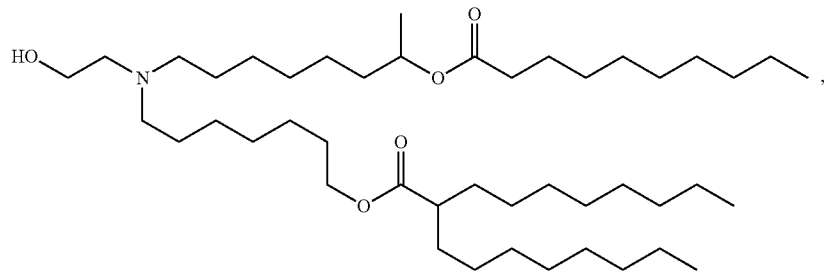
(Compound 166)
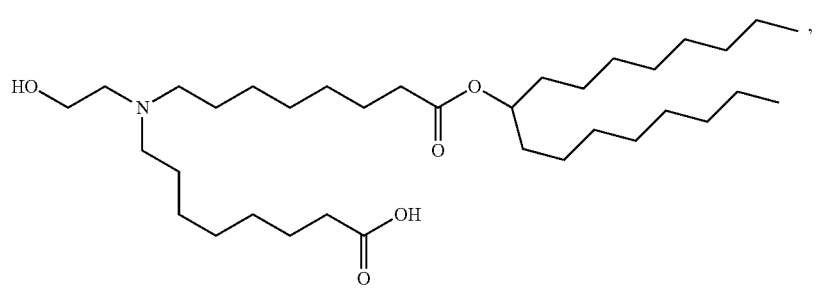

-continued
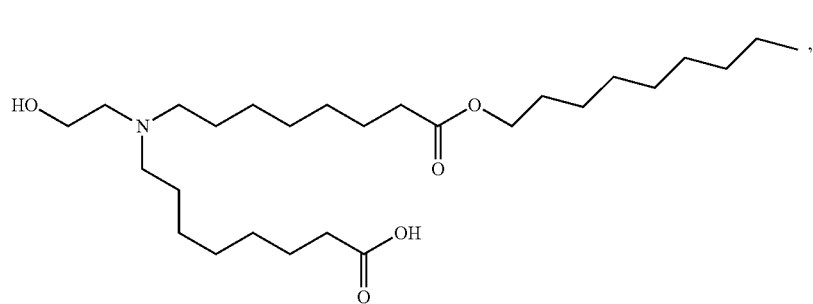
(Compound 167)
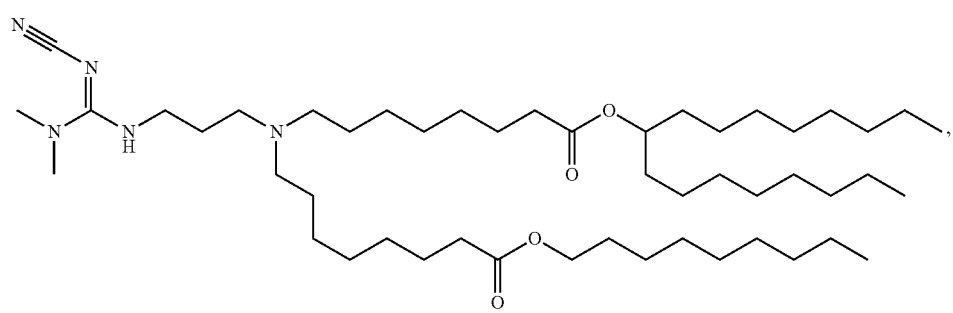
(Compound 168)
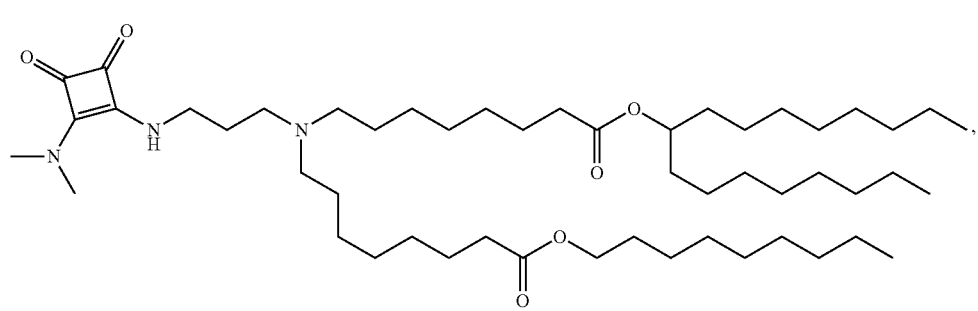
(Compound 169)
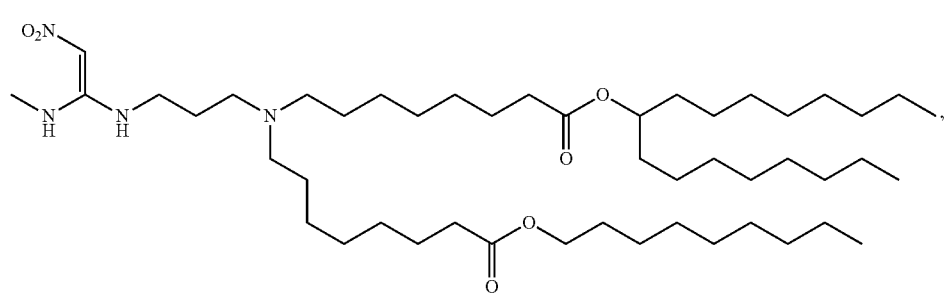
(Compound 170)
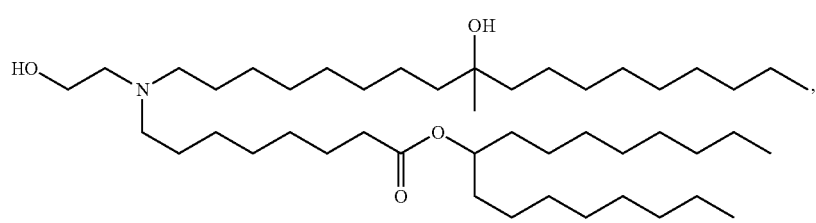
(Compound 171)
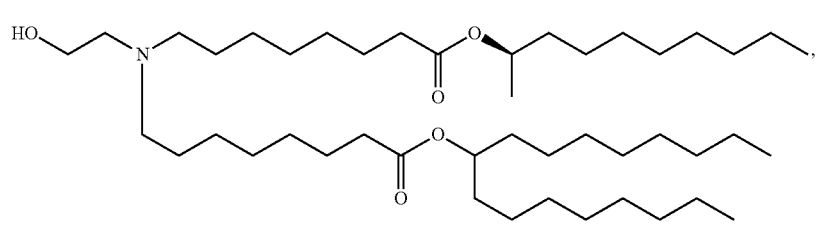
(Compound 172)

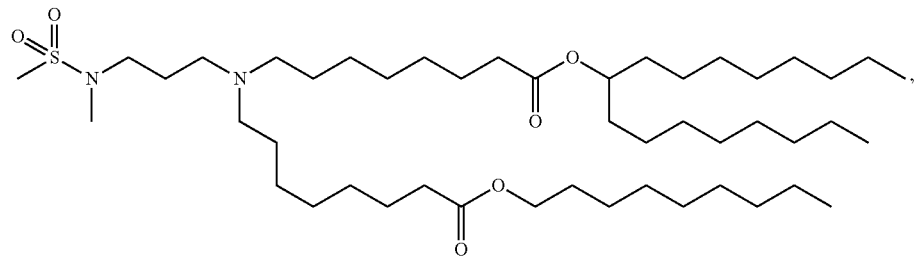
(Compound 173)
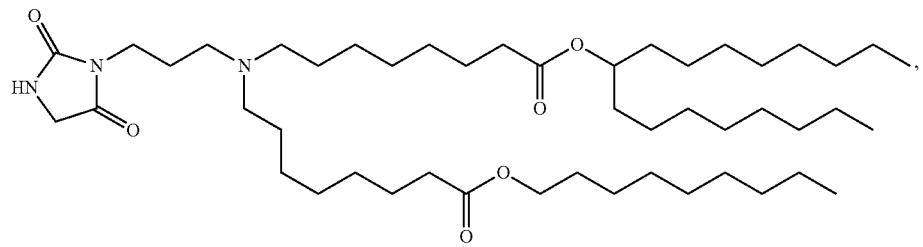
(Compound 174)
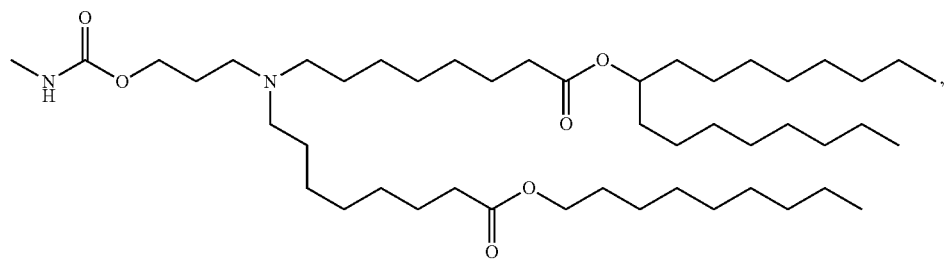
(Compound 175)
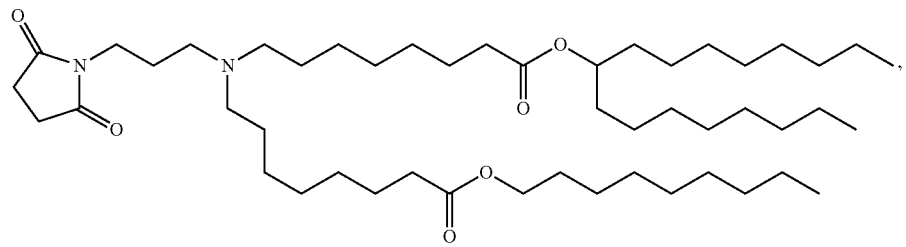
(Compound 176)
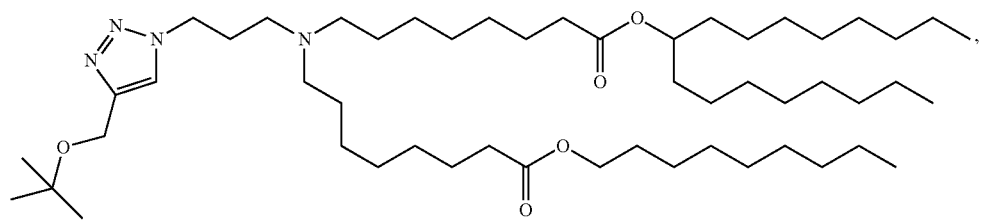
(Compound 177)
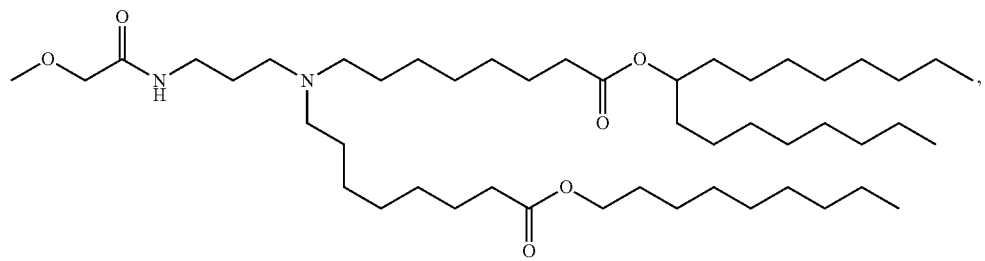
(Compound 178)

-continued
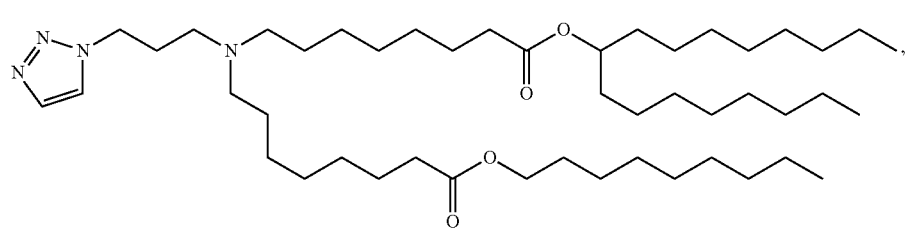
(Compound 179)
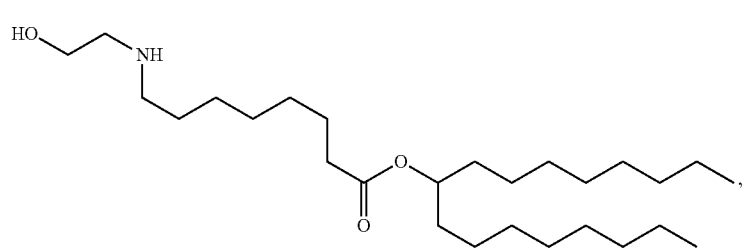
(Compound 180)
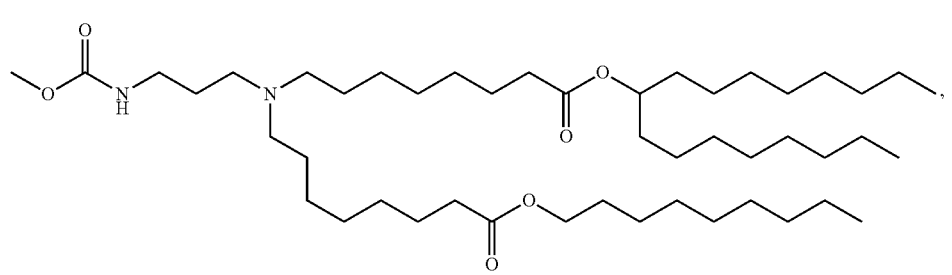
(Compound 181)
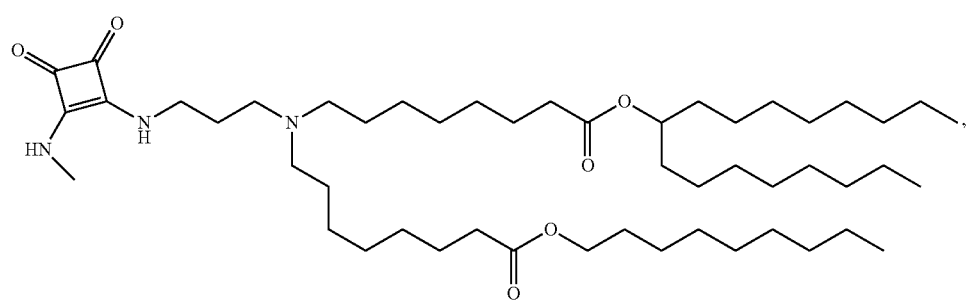
(Compound 182)
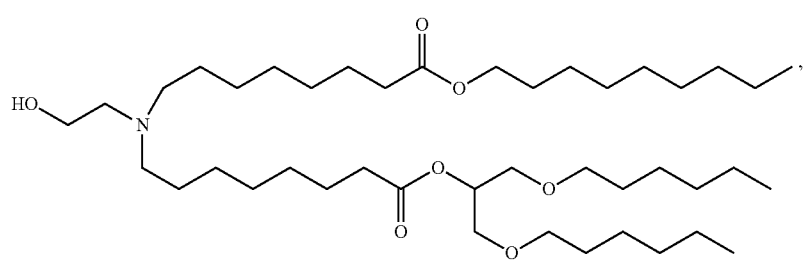
(Compound 183)
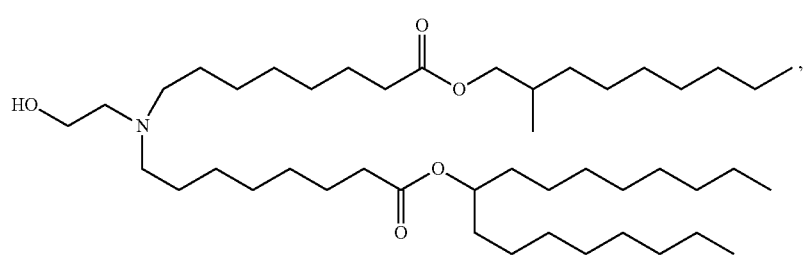
(Compound 184)

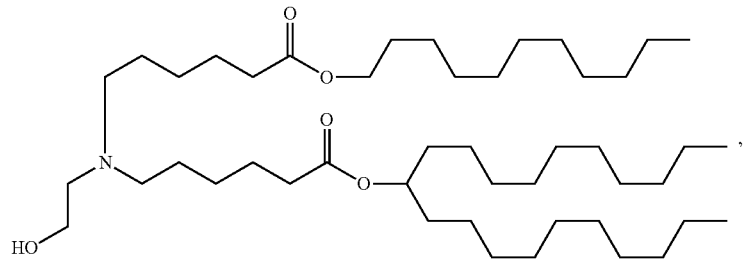
(Compound 185)
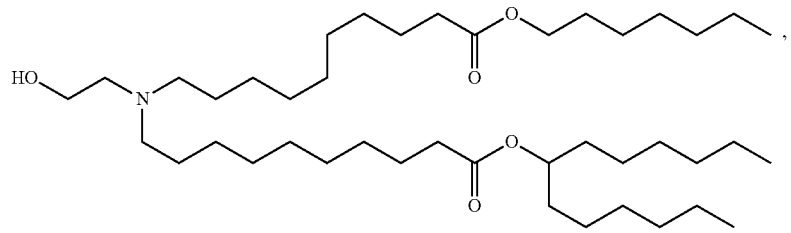
(Compound 186)
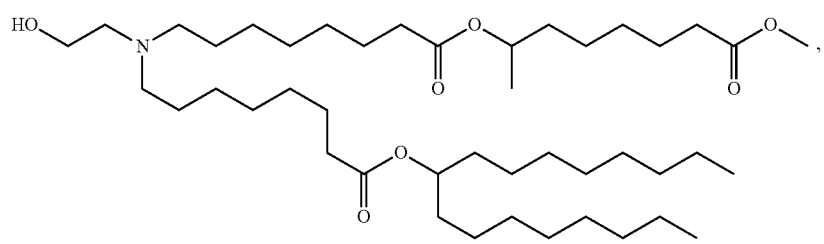
(Compound 187)
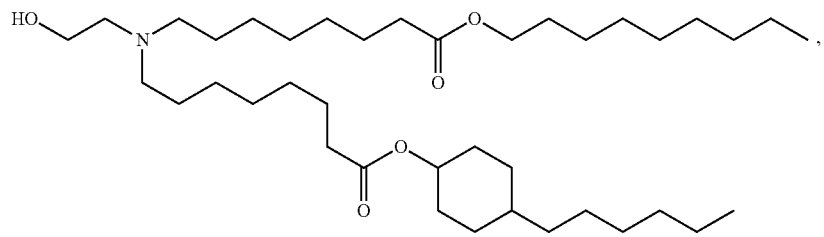
(Compound 188)
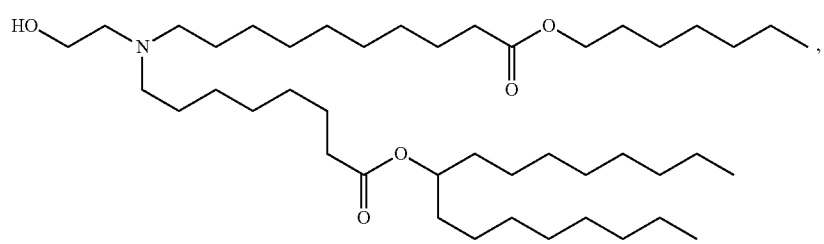
(Compound 189)
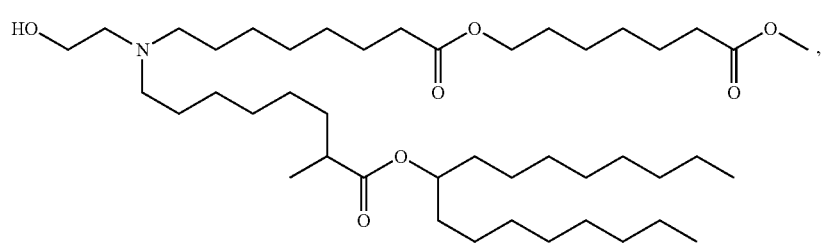
(Compound 190)

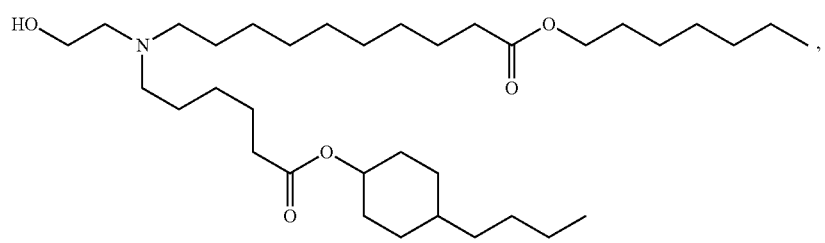
(Compound 191)
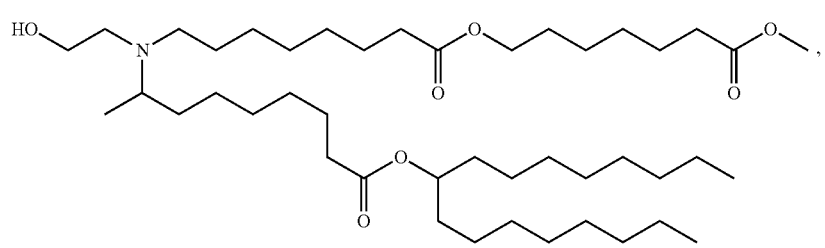
(Compound 192)
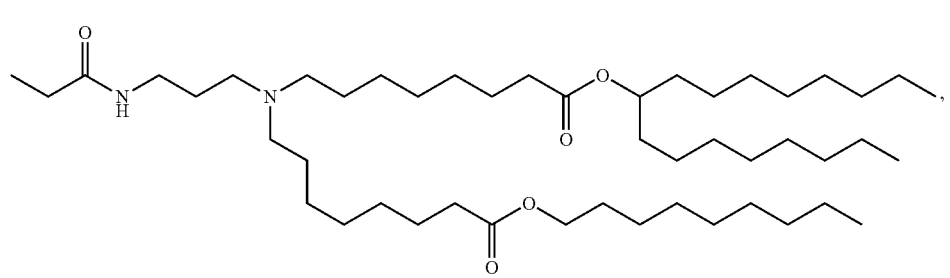
(Compound 193)
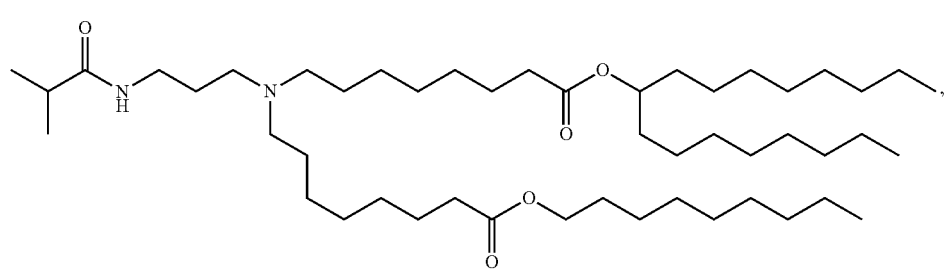
(Compound 194)
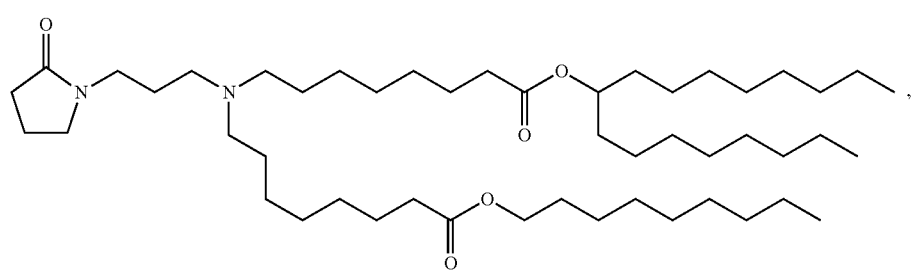
(Compound 195)
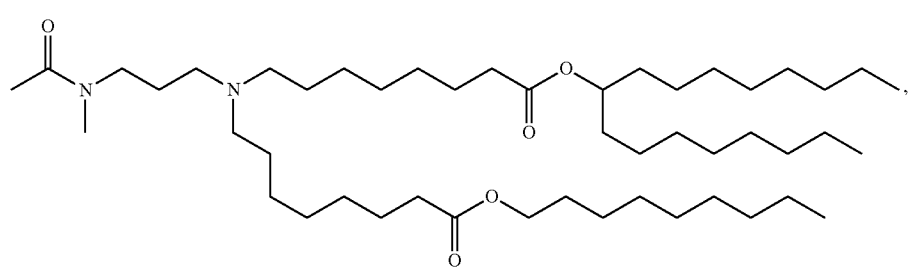
(Compound 196)

-continued
(Compound 197)
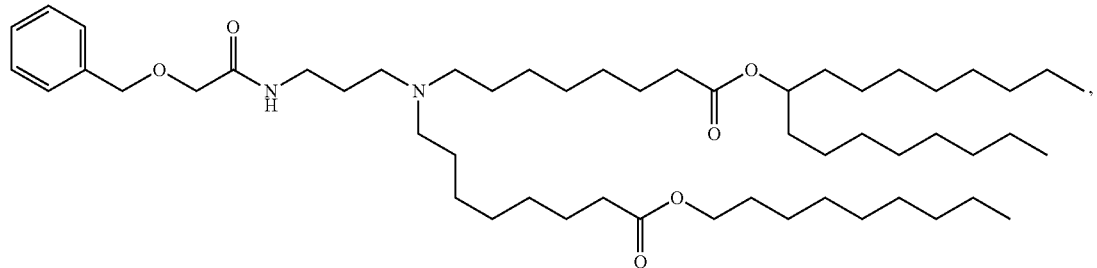
(Compound 198)
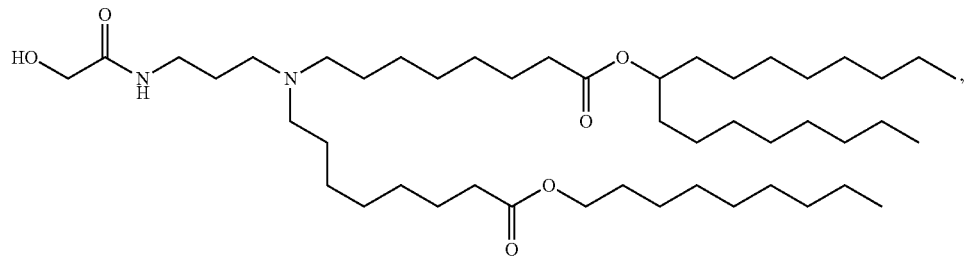
(Compound 199)
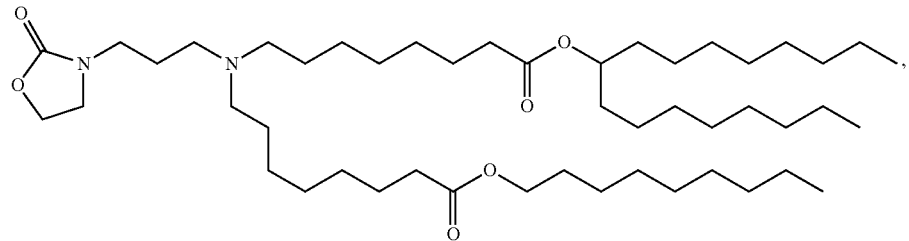
(Compound 200)
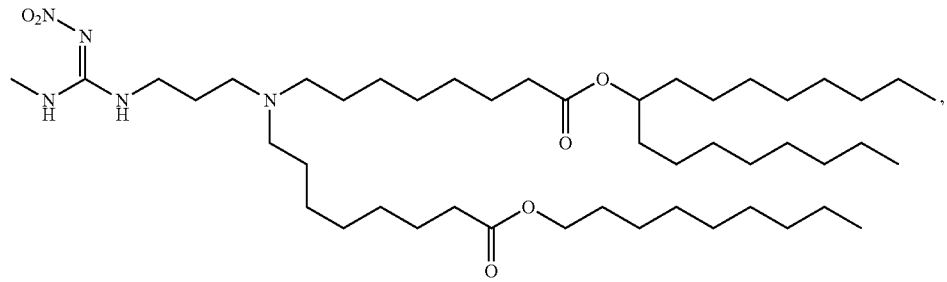
(Compound 201)
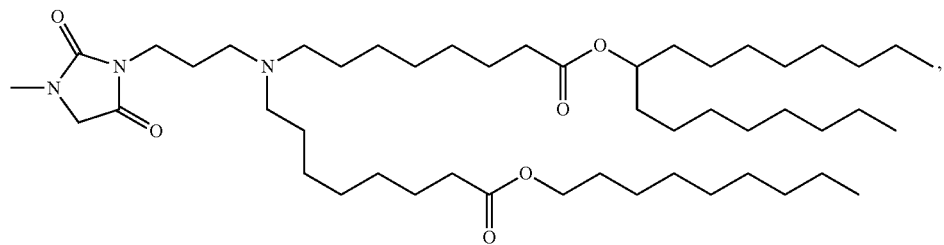
(Compound 202)
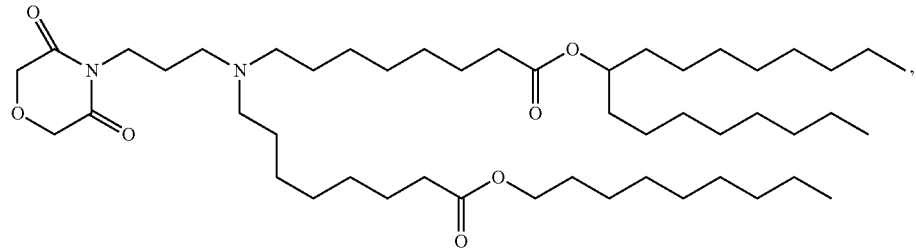

(Compound 203)
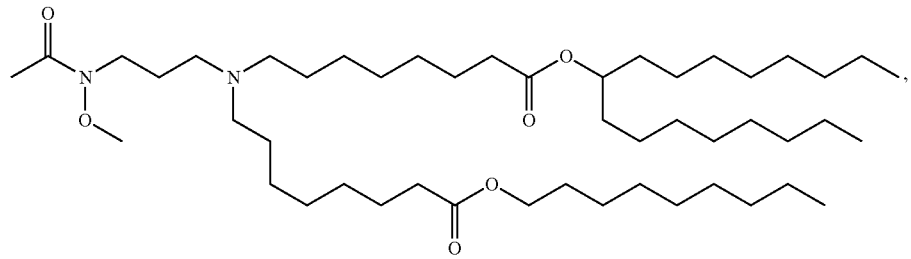
(Compound 204)
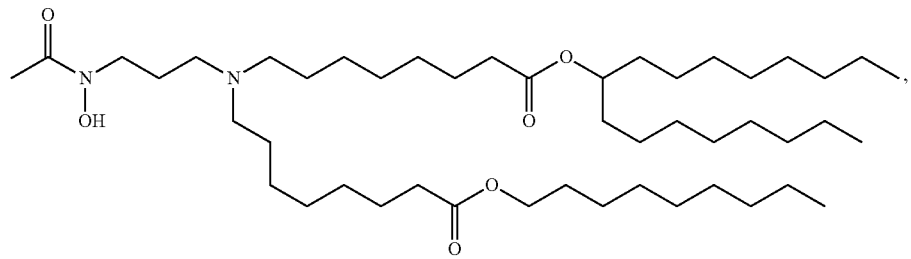
(Compound 205)
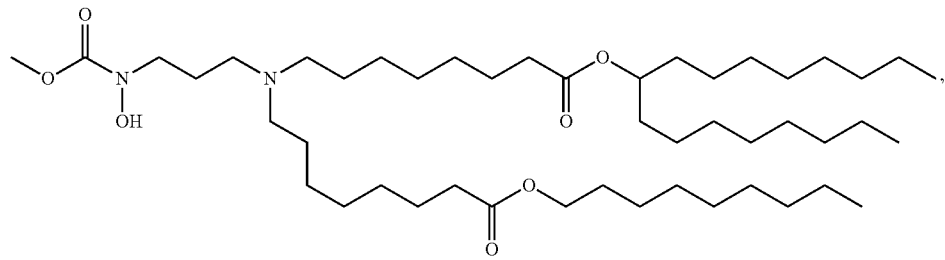
(Compound 206)
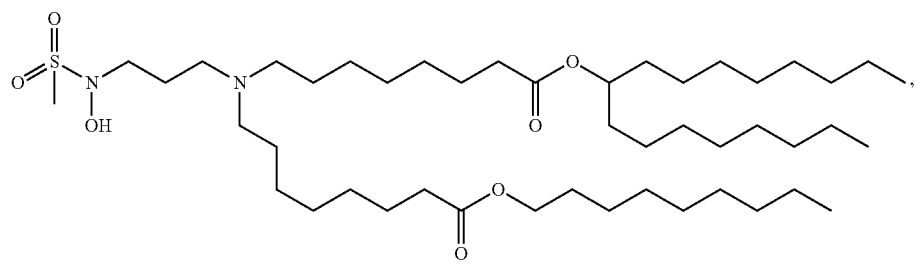
(Compound 207)
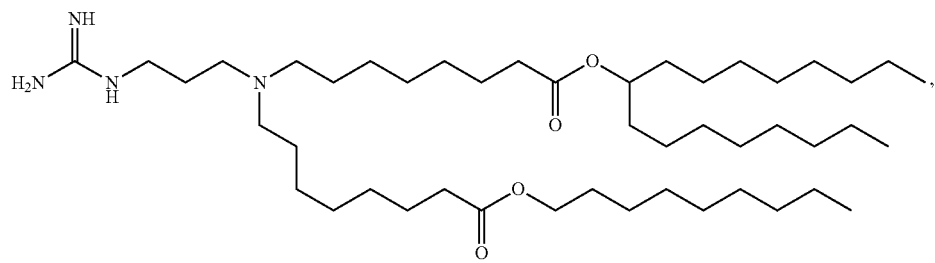
(Compound 208)
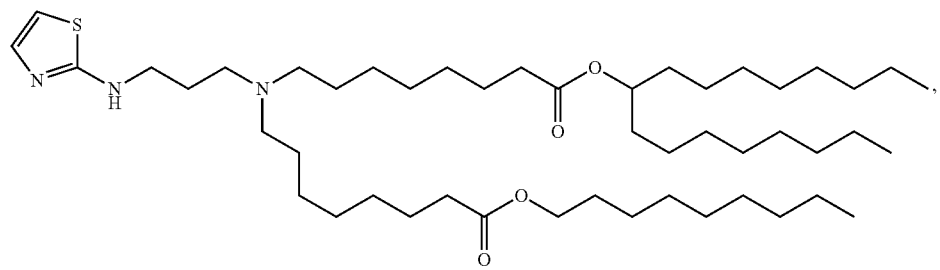

(Compound 209)
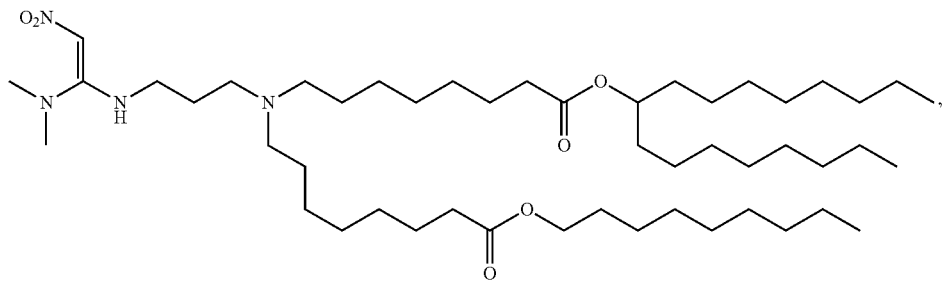
(Compound 210)
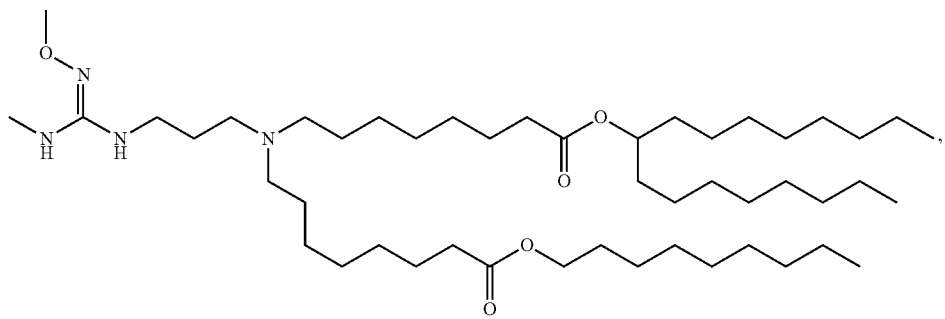
(Compound 211)
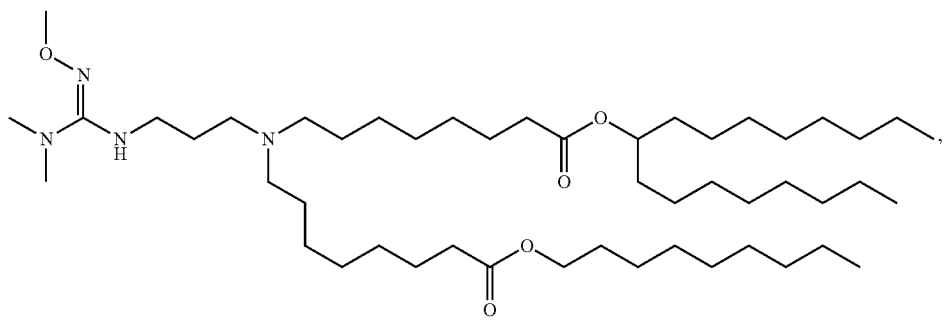
(Compound 212)
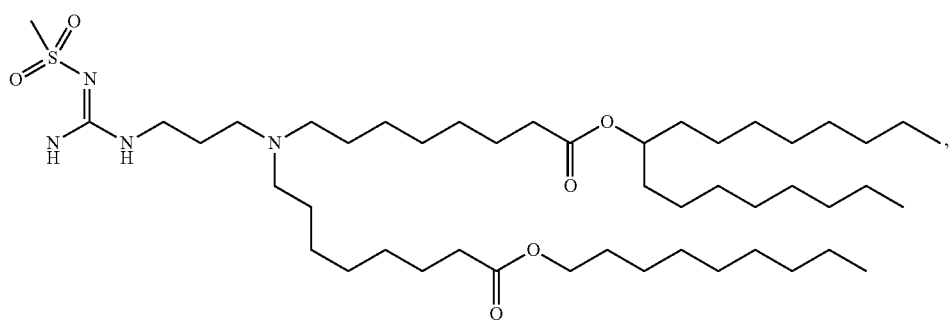
(Compound 213)
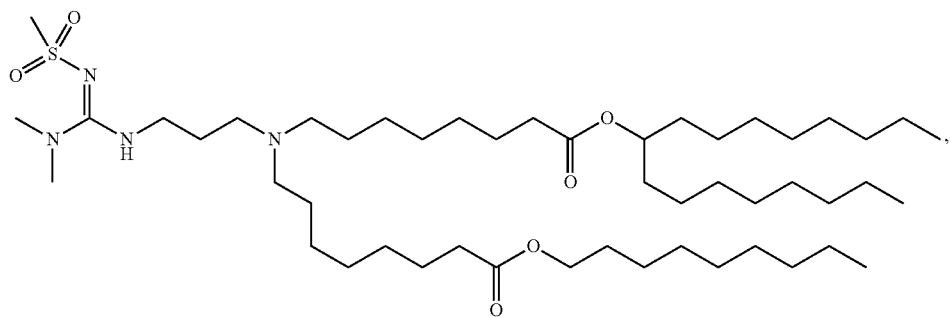

-continued
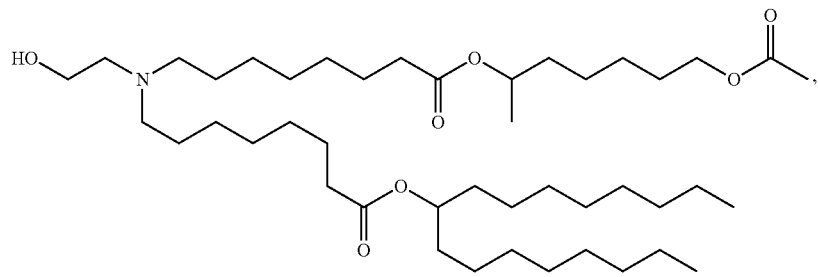
(Compound 214)
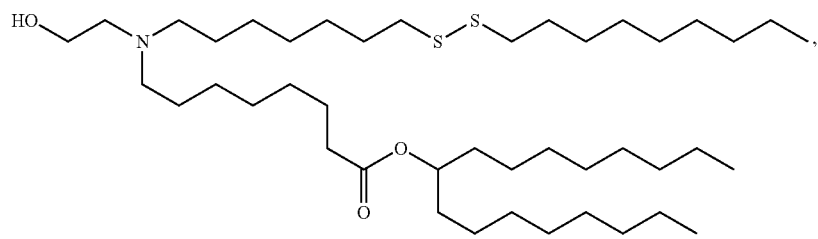
(Compound 215)
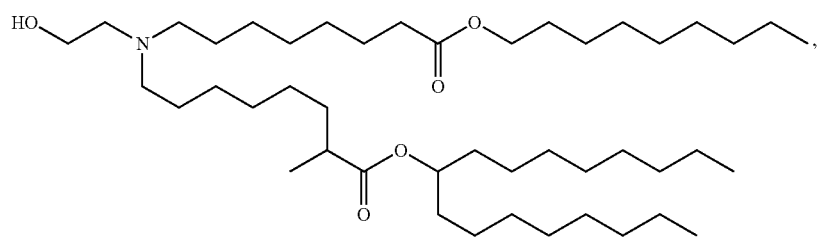
(Compound 216)
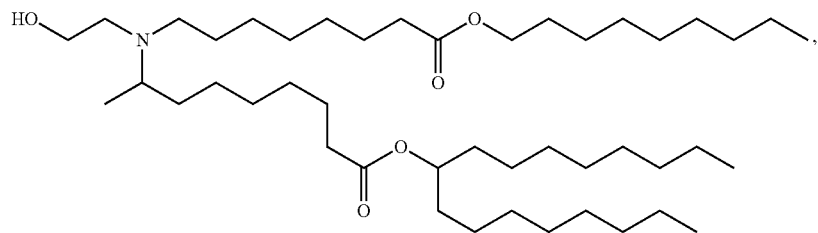
(Compound 217)
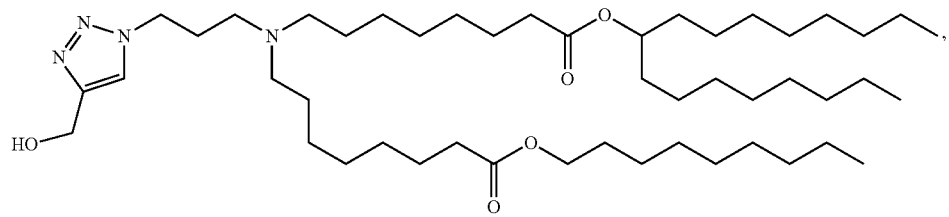
(Compound 218)
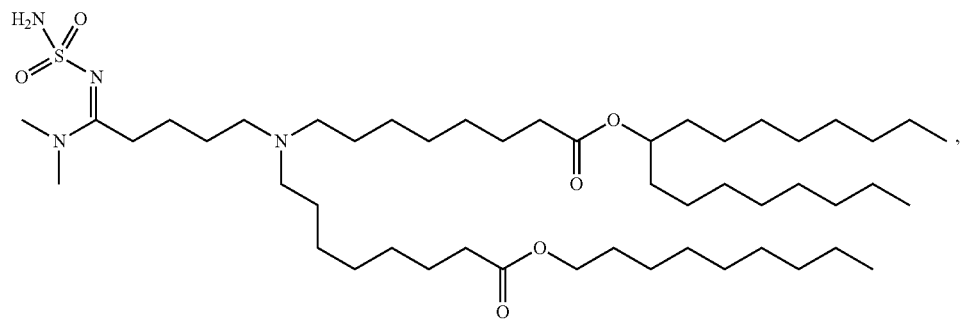
(Compound 219)

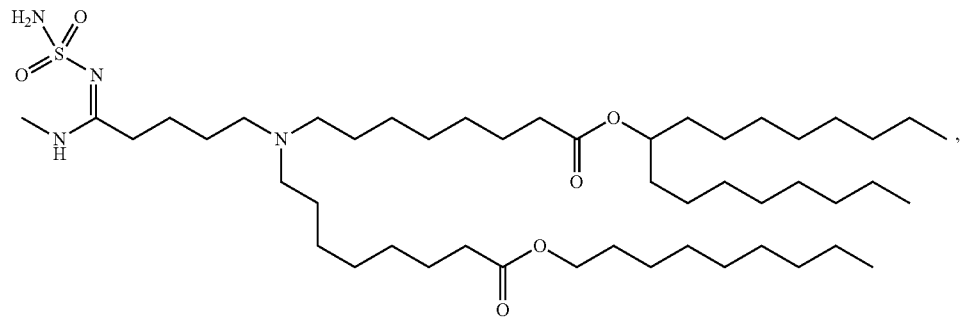
(Compound 220)
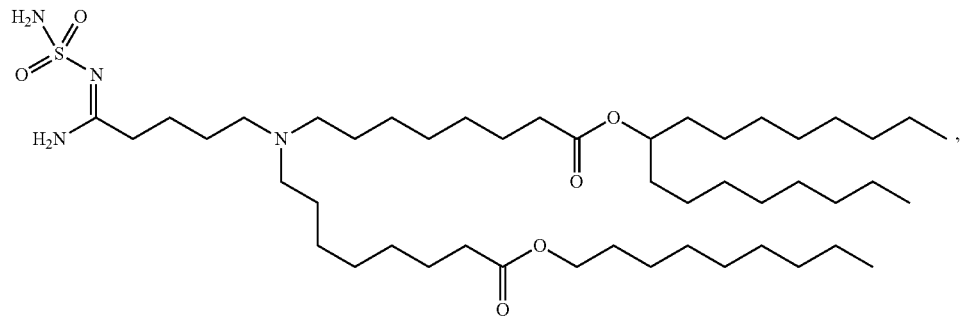
(Compound 221)
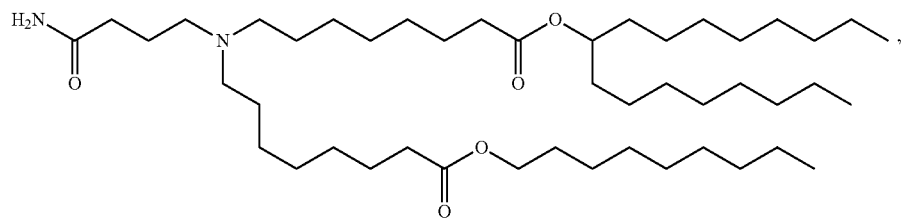
(Compound 222)
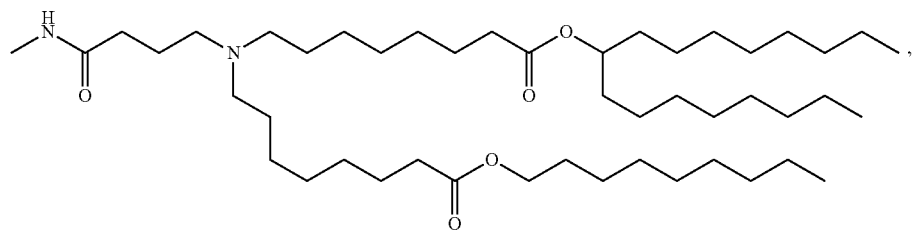
(Compound 223)
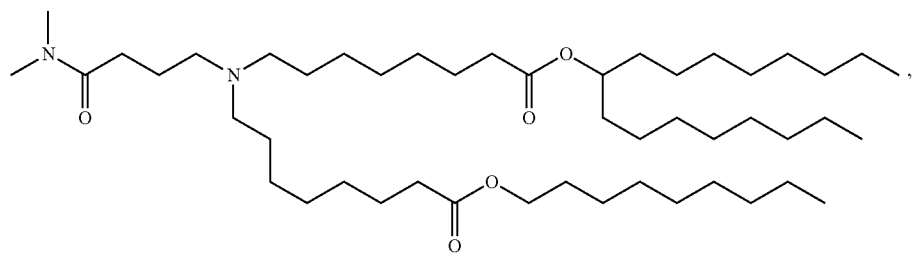
(Compound 224)
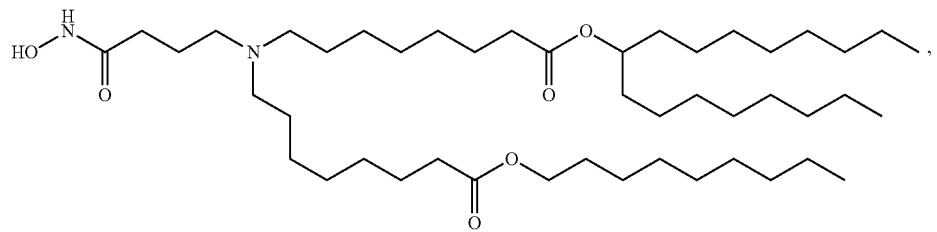
(Compound 225)

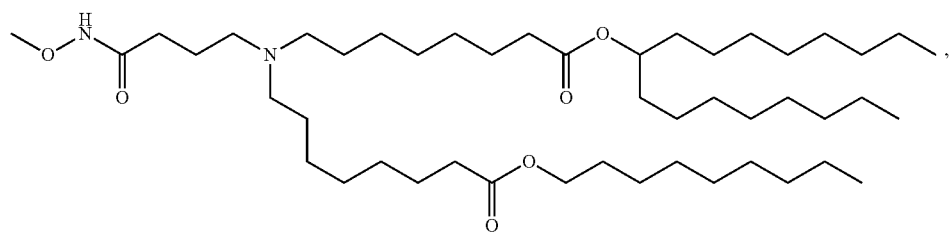
(Compound 226)
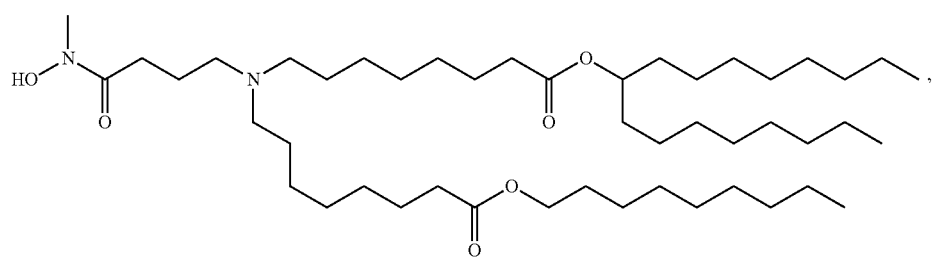
(Compound 227)
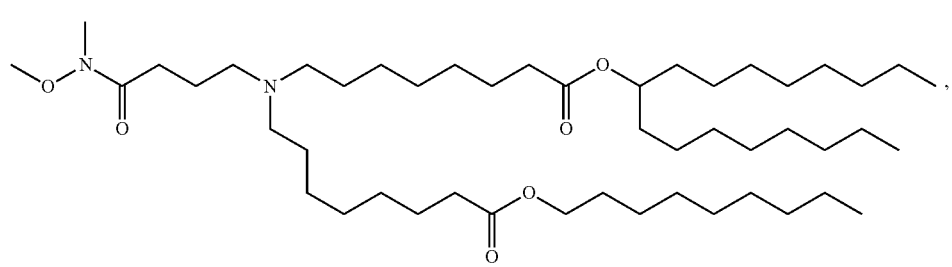
(Compound 228)
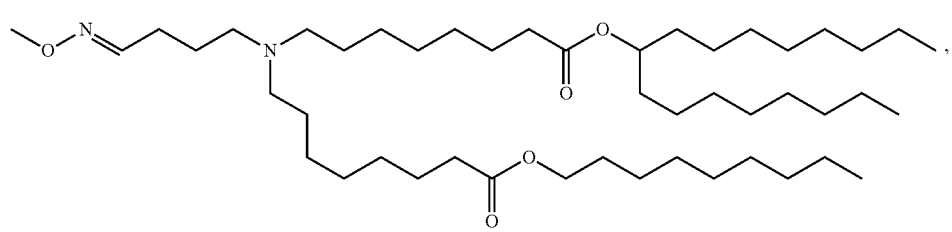
(Compound 229)
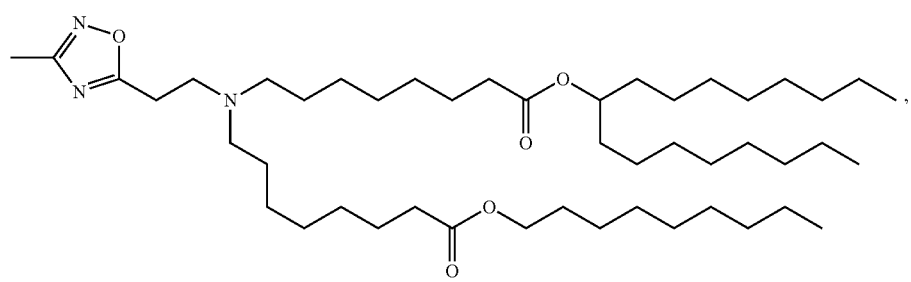
(Compound 230)
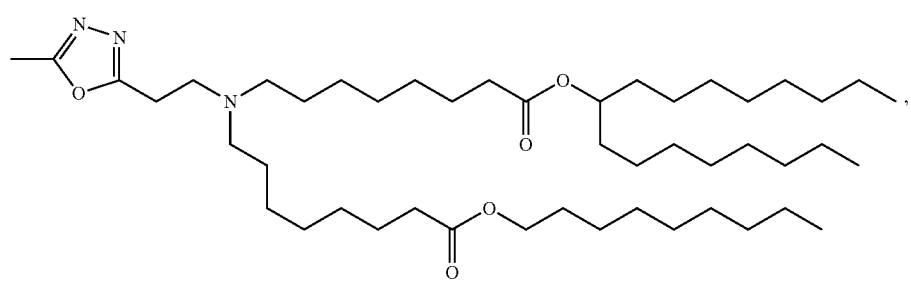
(Compound 231)

(Compound 232)

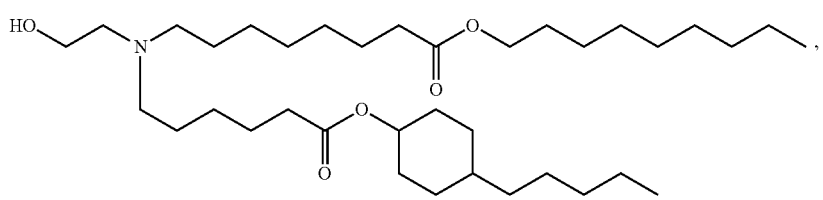

and salts and isomers thereof.

In some embodiments, a nanoparticle comprises the following compound:

(Compound 233)

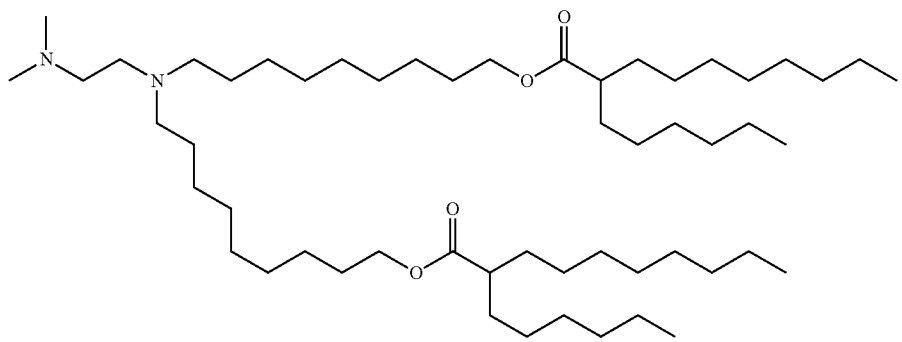

or salts and isomers thereof.

In some embodiments, the disclosure features a nanoparticle composition including a lipid component comprising a compound as described herein (e.g., a compound according to Formula (I), (IA), (II), (IIa), (IIb), (IIc), (IId) or (IIe)).

In some embodiments, the disclosure features a pharmaceutical composition comprising a nanoparticle composition according to the preceding embodiments and a pharmaceutically acceptable carrier. For example, the pharmaceutical composition is refrigerated or frozen for storage and/or shipment (e.g., being stored at a temperature of 4° C. or lower, such as a temperature between about −150° C. and about 0° C. or between about −80° C. and about −20° C. (e.g., about −5° C., −10° C., −15° C., −20° C., −25° C., −30° C., −40° C., −50° C., −60° C., −70° C., −80° C., −90° C., −130° C. or −150° C.). For example, the pharmaceutical composition is a solution that is refrigerated for storage and/or shipment at, for example, about −20° C., −30° C., −40° C., −50° C., −60° C., −70° C., or −80° C.

In some embodiments, the disclosure provides a method of delivering a therapeutic and/or prophylactic (e.g., RNA, such as mRNA) to a cell (e.g., a mammalian cell). This method includes the step of administering to a subject (e.g., a mammal, such as a human) a nanoparticle composition including (i) a lipid component including a phospholipid (such as a polyunsaturated lipid), a PEG lipid, a structural lipid, and a compound of Formula (I), (IA), (II), (IIa), (IIb), (IIc), (IId) or (IIe) and (ii) a therapeutic and/or prophylactic, in which administering involves contacting the cell with the nanoparticle composition, whereby the therapeutic and/or prophylactic is delivered to the cell.

In some embodiments, the disclosure provides a method of producing a polypeptide of interest in a cell (e.g., a mammalian cell). The method includes the step of contacting the cell with a nanoparticle composition including (i) a lipid component including a phospholipid (such as a polyunsaturated lipid), a PEG lipid, a structural lipid, and a compound of Formula (I), (IA), (II), (IIa), (IIb), (IIc), (IId) or (IIe) and (ii) an mRNA encoding the polypeptide of interest, whereby the mRNA is capable of being translated in the cell to produce the polypeptide.

In some embodiments, the disclosure provides a method of treating a disease or disorder in a mammal (e.g., a human) in need thereof. The method includes the step of administering to the mammal a therapeutically effective amount of a nanoparticle composition including (i) a lipid component including a phospholipid (such as a polyunsaturated lipid), a PEG lipid, a structural lipid, and a compound of Formula (I), (IA), (II), (IIa), (IIb), (IIc), (IId) or (IIe) and (ii) a therapeutic and/or prophylactic (e.g., an mRNA). In some embodiments, the disease or disorder is characterized by dysfunctional or aberrant protein or polypeptide activity. For example, the disease or disorder is selected from the group consisting of rare diseases, infectious diseases, cancer and proliferative diseases, genetic diseases (e.g., cystic fibrosis), autoimmune diseases, diabetes, neurodegenerative diseases, cardio- and reno-vascular diseases, and metabolic diseases.

In some embodiments, the disclosure provides a method of delivering (e.g., specifically delivering) a therapeutic and/or prophylactic to a mammalian organ (e.g., a liver, spleen, lung, or femur). This method includes the step of administering to a subject (e.g., a mammal) a nanoparticle composition including (i) a lipid component including a phospholipid, a PEG lipid, a structural lipid, and a compound of Formula (I), (IA), (II), (IIa), (IIb), (IIc), (II) or (IIe) and (ii) a therapeutic and/or prophylactic (e.g., an mRNA), in which administering involves contacting the cell with the nanoparticle composition, whereby the therapeutic and/or prophylactic is delivered to the target organ (e.g., a liver, spleen, lung, or femur).

In some embodiments, the disclosure features a method for the enhanced delivery of a therapeutic and/or prophylactic (e.g., an mRNA) to a target tissue (e.g., a liver, spleen, lung, or femur). This method includes administering to a subject (e.g., a mammal) a nanoparticle composition, the composition including (i) a lipid component including a compound of Formula (I), (IA), (II), (IIa), (IIb), (IIc), (II) or (IIe), a phospholipid, a structural lipid, and a PEG lipid; and (ii) a therapeutic and/or prophylactic, the administering including contacting the target tissue with the nanoparticle composition, whereby the therapeutic and/or prophylactic is delivered to the target tissue.

In some embodiments, the disclosure features a method of lowering immunogenicity comprising introducing the nanoparticle composition of the disclosure into cells, wherein the nanoparticle composition reduces the induction of the cellular immune response of the cells to the nanoparticle composition, as compared to the induction of the cellular immune response in cells induced by a reference composition which comprises a reference lipid instead of a compound of Formula (I), (IA), (II), (IIa), (IIb), (IIc), (II) or (IIe). For example, the cellular immune response is an innate immune response, an adaptive immune response, or both.

The disclosure also includes methods of synthesizing a compound of Formula (I), (IA), (II), (IIa), (IIb), (IIc), (II) or (IIe) and methods of making a nanoparticle composition including a lipid component comprising the compound of Formula (I), (IA), (II), (IIa), (IIb), (IIc), (IId) or (IIe).

Modes of Vaccine Administration

Tropical disease RNA (e.g. mRNA) vaccines may be administered by any route which results in a therapeutically effective outcome. These include, but are not limited, to intradermal, intramuscular, intranasal and/or subcutaneous administration. The present disclosure provides methods comprising administering RNA (e.g., mRNA) vaccines to a subject in need thereof. The exact amount required will vary from subject to subject, depending on the species, age, and general condition of the subject, the severity of the disease, the particular composition, its mode of administration, its mode of activity, and the like. Tropical disease RNA (e.g., mRNA) vaccines compositions are typically formulated in dosage unit form for ease of administration and uniformity of dosage. It will be understood, however, that the total daily usage of RNA (e.g., mRNA) vaccine compositions may be decided by the attending physician within the scope of sound medical judgment. The specific therapeutically effective, prophylactically effective, or appropriate imaging dose level for any particular patient will depend upon a variety of factors including the disorder being treated and the severity of the disorder; the activity of the specific compound employed; the specific composition employed; the age, body weight, general health, sex and diet of the patient; the time of administration, route of administration, and rate of excretion of the specific compound employed; the duration of the treatment; drugs used in combination or coincidental with the specific compound employed; and like factors well known in the medical arts.

In some embodiments, tropical disease RNA (e.g. mRNA) vaccines compositions may be administered at dosage levels sufficient to deliver 0.0001 mg/kg to 100 mg/kg, 0.001 mg/kg to 0.05 mg/kg, 0.005 mg/kg to 0.05 mg/kg, 0.001 mg/kg to 0.005 mg/kg, 0.05 mg/kg to 0.5 mg/kg, 0.01 mg/kg to 50 mg/kg, 0.1 mg/kg to 40 mg/kg, 0.5 mg/kg to 30 mg/kg, 0.01 mg/kg to 10 mg/kg, 0.1 mg/kg to 10 mg/kg, or 1 mg/kg to 25 mg/kg, of subject body weight per day, one or more times a day, per week, per month, etc. to obtain the desired therapeutic, diagnostic, prophylactic, or imaging effect (see, e.g., the range of unit doses described in International Publication No WO2013078199, the contents of which are herein incorporated by reference in their entirety). The desired dosage may be delivered three times a day, two times a day, once a day, every other day, every third day, every week, every two weeks, every three weeks, every four weeks, every 2 months, every three months, every 6 months, etc. In some embodiments, the desired dosage may be delivered using multiple administrations (e.g., two, three, four, five, six, seven, eight, nine, ten, eleven, twelve, thirteen, fourteen, or more administrations). When multiple administrations are employed, split dosing regimens such as those described herein may be used. In exemplary embodiments, tropical disease RNA (e.g., mRNA) vaccines compositions may be administered at dosage levels sufficient to deliver 0.0005 mg/kg to 0.01 mg/kg, e.g., about 0.0005 mg/kg to about 0.0075 mg/kg, e.g., about 0.0005 mg/kg, about 0.001 mg/kg, about 0.002 mg/kg, about 0.003 mg/kg, about 0.004 mg/kg or about 0.005 mg/kg.

In some embodiments, tropical disease RNA (e.g., mRNA) vaccine compositions may be administered once or twice (or more) at dosage levels sufficient to deliver 0.025 mg/kg to 0.250 mg/kg, 0.025 mg/kg to 0.500 mg/kg, 0.025 mg/kg to 0.750 mg/kg, or 0.025 mg/kg to 1.0 mg/kg.

In some embodiments, tropical disease RNA (e.g., mRNA) vaccine compositions may be administered twice (e.g., Day 0 and Day 7, Day 0 and Day 14, Day 0 and Day 21, Day 0 and Day 28, Day 0 and Day 60, Day 0 and Day 90, Day 0 and Day 120, Day 0 and Day 150, Day 0 and Day 180, Day 0 and 3 months later, Day 0 and 6 months later, Day 0 and 9 months later, Day 0 and 12 months later, Day 0 and 18 months later, Day 0 and 2 years later, Day 0 and 5 years later, or Day 0 and 10 years later) at a total dose of or at dosage levels sufficient to deliver a total dose of 0.0100 mg, 0.025 mg, 0.050 mg, 0.075 mg, 0.100 mg, 0.125 mg, 0.150 mg, 0.175 mg, 0.200 mg, 0.225 mg, 0.250 mg, 0.275 mg, 0.300 mg, 0.325 mg, 0.350 mg, 0.375 mg, 0.400 mg, 0.425 mg, 0.450 mg, 0.475 mg, 0.500 mg, 0.525 mg, 0.550 mg, 0.575 mg, 0.600 mg, 0.625 mg, 0.650 mg, 0.675 mg, 0.700 mg, 0.725 mg, 0.750 mg, 0.775 mg, 0.800 mg, 0.825 mg, 0.850 mg, 0.875 mg, 0.900 mg, 0.925 mg, 0.950 mg, 0.975 mg, or 1.0 mg. Higher and lower dosages and frequency of administration are encompassed by the present disclosure. For example, a tropical disease RNA (e.g., mRNA) vaccine composition may be administered three or four times.

In some embodiments, tropical disease RNA (e.g., mRNA) vaccine compositions may be administered twice (e.g., Day 0 and Day 7, Day 0 and Day 14, Day 0 and Day 21, Day 0 and Day 28, Day 0 and Day 60, Day 0 and Day 90, Day 0 and Day 120, Day 0 and Day 150, Day 0 and Day 180, Day 0 and 3 months later, Day 0 and 6 months later, Day 0 and 9 months later, Day 0 and 12 months later, Day 0 and 18 months later, Day 0 and 2 years later, Day 0 and 5 years later, or Day 0 and 10 years later) at a total dose of or at dosage levels sufficient to deliver a total dose of 0.010 mg, 0.025 mg, 0.100 mg or 0.400 mg.

In some embodiments, the tropical disease RNA (e.g., mRNA) vaccine for use in a method of vaccinating a subject is administered to the subject as a single dosage of between 10 µg/kg and 400 µg/kg of the nucleic acid vaccine (in an effective amount to vaccinate the subject). In some embodiments the RNA (e.g., mRNA) vaccine for use in a method of vaccinating a subject is administered to the subject as a single dosage of between 10 µg and 400 µg of the nucleic acid vaccine (in an effective amount to vaccinate the subject). In some embodiments, a tropical disease RNA (e.g., mRNA) vaccine for use in a method of vaccinating a subject is administered to the subject as a single dosage of 25-1000 µg (e.g., a single dosage of mRNA encoding Malaria (e.g.,

*P. falciparum, P. vivax, P. malariae* and/or *P. ovale*), JEV, WNV, EEEV, VEEV, SINV, CHIKV, DENV, ZIKV and/or YFV antigen). In some embodiments, a tropical disease RNA (e.g., mRNA) vaccine is administered to the subject as a single dosage of 25, 50, 100, 150, 200, 250, 300, 350, 400, 450, 500, 550, 600, 650, 700, 750, 800, 850, 900, 950 or 1000 µg. For example, a tropical disease RNA (e.g., mRNA) vaccine may be administered to a subject as a single dose of 25-100, 25-500, 50-100, 50-500, 50-1000, 100-500, 100-1000, 250-500, 250-1000, or 500-1000 µg. In some embodiments, a tropical disease RNA (e.g., mRNA) vaccine for use in a method of vaccinating a subject is administered to the subject as two dosages, the combination of which equals 25-1000 µg of the tropical disease RNA (e.g., mRNA) vaccine.

A tropical disease RNA (e.g. mRNA) vaccine pharmaceutical composition described herein can be formulated into a dosage form described herein, such as an intranasal, intratracheal, or injectable (e.g., intravenous, intraocular, intravitreal, intramuscular, intradermal, intracardiac, intraperitoneal, intranasal and subcutaneous).

Tropical Disease RNA (e.g., mRNA) Vaccine Formulations and Methods of Use

Some aspects of the present disclosure provide formulations of the tropical disease RNA (e.g., mRNA) vaccine, wherein the RNA (e.g., mRNA) vaccine is formulated in an effective amount to produce an antigen specific immune response in a subject (e.g., production of antibodies specific to an Malaria (e.g., *P. falciparum, P. vivax, P. malariae* and/or *P. ovale*), JEV, WNV, EEEV, VEEV, SINV, CHIKV, DENV, ZIKV and/or YFV antigenic polypeptide). An "effective amount" is a dose of an RNA (e.g., mRNA) vaccine effective to produce an antigen-specific immune response. Also provided herein are methods of inducing an antigen-specific immune response in a subject.

In some embodiments, the antigen-specific immune response is characterized by measuring an anti-Malaria (e.g., *P. falciparum, P. vivax, P. malariae* and/or *P. ovale*), JEV, WNV, EEEV, VEEV, SINV, CHIKV, DENV, ZIKV and/or YFV antigenic polypeptide antibody titer produced in a subject administered a tropical disease RNA (e.g., mRNA) vaccine as provided herein. An antibody titer is a measurement of the amount of antibodies within a subject, for example, antibodies that are specific to a particular antigen (e.g., an Malaria (e.g., *P. falciparum, P. vivax, P. malariae* and/or *P. ovale*), JEV, WNV, EEEV, VEEV, SINV, CHIKV, DENV, ZIKV and/or YFV antigenic polypeptide) or epitope of an antigen. Antibody titer is typically expressed as the inverse of the greatest dilution that provides a positive result. Enzyme-linked immunosorbent assay (ELISA) is a common assay for determining antibody titers, for example.

In some embodiments, an antibody titer is used to assess whether a subject has had an infection or to determine whether immunizations are required. In some embodiments, an antibody titer is used to determine the strength of an autoimmune response, to determine whether a booster immunization is needed, to determine whether a previous vaccine was effective, and to identify any recent or prior infections. In accordance with the present disclosure, an antibody titer may be used to determine the strength of an immune response induced in a subject by the tropical disease RNA (e.g., mRNA) vaccine.

In some embodiments, an anti-antigenic polypeptide (e.g., an anti-Malaria (e.g., *P. falciparum, P. vivax, P. malariae* and/or *P. ovale*), JEV, WNV, EEEV, VEEV, SINV, CHIKV, DENV, ZIKV and/or YFV antigenic polypeptide) antibody titer produced in a subject is increased by at least 1 log relative to a control. For example, anti-antigenic polypeptide antibody titer produced in a subject may be increased by at least 1.5, at least 2, at least 2.5, or at least 3 log relative to a control. In some embodiments, the anti-antigenic polypeptide antibody titer produced in the subject is increased by 1, 1.5, 2, 2.5 or 3 log relative to a control. In some embodiments, the anti-antigenic polypeptide antibody titer produced in the subject is increased by 1-3 log relative to a control. For example, the anti-antigenic polypeptide antibody titer produced in a subject may be increased by 1-1.5, 1-2, 1-2.5, 1-3, 1.5-2, 1.5-2.5, 1.5-3, 2-2.5, 2-3, or 2.5-3 log relative to a control.

In some embodiments, the anti-antigenic polypeptide (e.g., an anti-Malaria (e.g., *P. falciparum, P. vivax, P. malariae* and/or *P. ovale*), JEV, WNV, EEEV, VEEV, SINV, CHIKV, DENV, ZIKV and/or YFV antigenic polypeptide) antibody titer produced in a subject is increased at least 2 times relative to a control. For example, the anti-antigenic polypeptide antibody titer produced in a subject may be increased at least 3 times, at least 4 times, at least 5 times, at least 6 times, at least 7 times, at least 8 times, at least 9 times, or at least 10 times relative to a control. In some embodiments, the anti-antigenic polypeptide antibody titer produced in the subject is increased 2, 3, 4, 5, 6, 7, 8, 9, or 10 times relative to a control. In some embodiments, the anti-antigenic polypeptide antibody titer produced in a subject is increased 2-10 times relative to a control. For example, the anti-antigenic polypeptide antibody titer produced in a subject may be increased 2-10, 2-9, 2-8, 2-7, 2-6, 2-5, 2-4, 2-3, 3-10, 3-9, 3-8, 3-7, 3-6, 3-5, 3-4, 4-10, 4-9, 4-8, 4-7, 4-6, 4-5, 5-10, 5-9, 5-8, 5-7, 5-6, 6-10, 6-9, 6-8, 6-7, 7-10, 7-9, 7-8, 8-10, 8-9, or 9-10 times relative to a control.

A control, in some embodiments, is the anti-antigenic polypeptide (e.g., an anti-Malaria (e.g., *P. falciparum, P. vivax, P. malariae* and/or *P. ovale*), JEV, WNV, EEEV, VEEV, SINV, CHIKV, DENV, ZIKV and/or YFV antigenic polypeptide) antibody titer produced in a subject who has not been administered a tropical disease RNA (e.g., mRNA) vaccine of the present disclosure. In some embodiments, a control is an anti-antigenic polypeptide (e.g., an anti-Malaria (e.g., *P. falciparum, P. vivax, P. malariae* and/or *P. ovale*), JEV, WNV, EEEV, VEEV, SINV, CHIKV, DENV, ZIKV and/or YFV antigenic polypeptide) antibody titer produced in a subject who has been administered a live attenuated Malaria (e.g., *P. falciparum, P. vivax, P. malariae* and/or *P. ovale*), JEV, WNV, EEEV, VEEV, SINV, CHIKV, DENV, ZIKV and/or YFV vaccine. An attenuated vaccine is a vaccine produced by reducing the virulence of a viable (live) virus. An attenuated virus is altered in a manner that renders it harmless or less virulent relative to a live, unmodified virus. In some embodiments, a control is an anti-antigenic polypeptide (e.g., an anti-Malaria (e.g., *P. falciparum, P. vivax, P. malariae* and/or *P. ovale*), JEV, WNV, EEEV, VEEV, SINV, CHIKV, DENV, ZIKV and/or YFV antigenic polypeptide) antibody titer produced in a subject administered inactivated Malaria (e.g., *P. falciparum, P. vivax, P. malariae* and/or *P. ovale*), JEV, WNV, EEEV, VEEV, SINV, CHIKV, DENV, ZIKV and/or YFV vaccine. In some embodiments, a control is an anti-antigenic polypeptide (e.g., an anti-Malaria (e.g., *P. falciparum, P. vivax, P. malariae* and/or *P. ovale*), JEV, WNV, EEEV, VEEV, SINV, CHIKV, DENV, ZIKV and/or YFV antigenic polypeptide) antibody titer produced in a subject administered a recombinant or purified Malaria (e.g., *P. falciparum, P. vivax, P. malariae* and/or *P. ovale*), JEV, WNV, EEEV, VEEV, SINV, CHIKV, DENV, ZIKV and/or YFV protein vaccine. Recombinant protein vaccines typically include protein antigens that either have been produced in a heterologous expression system (e.g., bacteria or yeast) or purified from large amounts of the pathogenic organism. In some embodiments, a control is an anti-antigenic polypeptide (e.g., an anti-Malaria (e.g., P. falciparum, P. vivax, P. malariae and/or P. ovale), JEV, WNV, EEEV, VEEV, SINV, CHIKV, DENV, ZIKV and/or YFV antigenic polypeptide) antibody titer produced in a subject who has been administered an Malaria (e.g., P. falciparum, P. vivax, P. malariae and/or P. ovale), JEV, WNV, EEEV, VEEV, SINV, CHIKV, DENV, ZIKV and/or YFV virus-like particle (VLP) vaccine.

In some embodiments, an effective amount of a tropical disease RNA (e.g., mRNA) vaccine is a dose that is reduced compared to the standard of care dose of a recombinant Malaria (e.g., P. falciparum, P. vivax, P. malariae and/or P. ovale), JEV, WNV, EEEV, VEEV, SINV, CHIKV, DENV, ZIKV and/or YFV protein vaccine. A "standard of care," as provided herein, refers to a medical or psychological treatment guideline and can be general or specific. "Standard of care" specifies appropriate treatment based on scientific evidence and collaboration between medical professionals involved in the treatment of a given condition. It is the diagnostic and treatment process that a physician/clinician should follow for a certain type of patient, illness or clinical circumstance. A "standard of care dose," as provided herein, refers to the dose of a recombinant or purified Malaria (e.g., P. falciparum, P. vivax, P. malariae and/or P. ovale), JEV, WNV, EEEV, VEEV, SINV, CHIKV, DENV, ZIKV and/or YFV protein vaccine, or a live attenuated or inactivated Malaria (e.g., P. falciparum, P. vivax, P. malariae and/or P. ovale), JEV, WNV, EEEV, VEEV, SINV, CHIKV, DENV, ZIKV and/or YFV vaccine, that a physician/clinician or other medical professional would administer to a subject to treat or prevent Malaria (e.g., P. falciparum, P. vivax, P. malariae and/or P. ovale), JEV, WNV, EEEV, VEEV, SINV, CHIKV, DENV, ZIKV and/or YFV, or a related condition, while following the standard of care guideline for treating or preventing Malaria (e.g., P. falciparum, P. vivax, P. malariae and/or P. ovale), JEV, WNV, EEEV, VEEV, SINV, CHIKV, DENV, ZIKV and/or YFV, or a related condition.

In some embodiments, the anti-antigenic polypeptide (e.g., an anti-Malaria (e.g., P. falciparum, P. vivax, P. malariae and/or P. ovale), JEV, WNV, EEEV, VEEV, SINV, CHIKV, DENV, ZIKV and/or YFV antigenic polypeptide) antibody titer produced in a subject administered an effective amount of a tropical disease RNA (e.g., mRNA) vaccine is equivalent to an anti-antigenic polypeptide (e.g., an anti-Malaria (e.g., P. falciparum, P. vivax, P. malariae and/or P. ovale), JEV, WNV, EEEV, VEEV, SINV, CHIKV, DENV, ZIKV and/or YFV antigenic polypeptide) antibody titer produced in a control subject administered a standard of care dose of a recombinant or purified Malaria (e.g., P. falciparum, P. vivax, P. malariae and/or P. ovale), JEV, WNV, EEEV, VEEV, SINV, CHIKV, DENV, ZIKV and/or YFV protein vaccine or a live attenuated or inactivated Malaria (e.g., P. falciparum, P. vivax, P. malariae and/or P. ovale), JEV, WNV, EEEV, VEEV, SINV, CHIKV, DENV, ZIKV and/or YFV vaccine.

In some embodiments, an effective amount of a tropical disease RNA (e.g., mRNA) vaccine is a dose equivalent to an at least 2-fold reduction in a standard of care dose of a recombinant or purified Malaria (e.g., P. falciparum, P. vivax, P. malariae and/or P. ovale), JEV, WNV, EEEV, VEEV, SINV, CHIKV, DENV, ZIKV and/or YFV protein vaccine. For example, an effective amount of a tropical disease RNA (e.g., mRNA) vaccine may be a dose equivalent to an at least 3-fold, at least 4-fold, at least 5-fold, at least 6-fold, at least 7-fold, at least 8-fold, at least 9-fold, or at least 10-fold reduction in a standard of care dose of a recombinant or purified Malaria (e.g., P. falciparum, P. vivax, P. malariae and/or P. ovale), JEV, WNV, EEEV, VEEV, SINV, CHIKV, DENV, ZIKV and/or YFV protein vaccine. In some embodiments, an effective amount of a tropical disease RNA (e.g., mRNA) vaccine is a dose equivalent to an at least at least 100-fold, at least 500-fold, or at least 1000-fold reduction in a standard of care dose of a recombinant or purified Malaria (e.g., P. falciparum, P. vivax, P. malariae and/or P. ovale), JEV, WNV, EEEV, VEEV, SINV, CHIKV, DENV, ZIKV and/or YFV protein vaccine. In some embodiments, an effective amount of a tropical disease RNA (e.g., mRNA) vaccine is a dose equivalent to a 2-, 3-, 4-, 5-, 6-, 7-, 8-, 9-, 10-, 20-, 50-, 100-, 250-, 500-, or 1000-fold reduction in a standard of care dose of a recombinant or purified Malaria (e.g., P. falciparum, P. vivax, P. malariae and/or P. ovale), JEV, WNV, EEEV, VEEV, SINV, CHIKV, DENV, ZIKV and/or YFV protein vaccine. In some embodiments, the anti-antigenic polypeptide antibody titer produced in a subject administered an effective amount of a tropical disease RNA (e.g., mRNA) vaccine is equivalent to an anti-antigenic polypeptide antibody titer produced in a control subject administered the standard of care dose of a recombinant or protein Malaria (e.g., P. falciparum, P. vivax, P. malariae and/or P. ovale), JEV, WNV, EEEV, VEEV, SINV, CHIKV, DENV, ZIKV and/or YFV protein vaccine or a live attenuated or inactivated Malaria (e.g., P. falciparum, P. vivax, P. malariae and/or P. ovale), JEV, WNV, EEEV, VEEV, SINV, CHIKV, DENV, ZIKV and/or YFV vaccine. In some embodiments, an effective amount of a tropical disease RNA (e.g., mRNA) vaccine is a dose equivalent to a 2-fold to 1000-fold (e.g., 2-fold to 100-fold, 10-fold to 1000-fold) reduction in the standard of care dose of a recombinant or purified Malaria (e.g., P. falciparum, P. vivax, P. malariae and/or P. ovale), JEV, WNV, EEEV, VEEV, SINV, CHIKV, DENV, ZIKV and/or YFV protein vaccine, wherein the anti-antigenic polypeptide antibody titer produced in the subject is equivalent to an anti-antigenic polypeptide antibody titer produced in a control subject administered the standard of care dose of a recombinant or purified Malaria (e.g., P. falciparum, P. vivax, P. malariae and/or P. ovale), JEV, WNV, EEEV, VEEV, SINV, CHIKV, DENV, ZIKV and/or YFV protein vaccine or a live attenuated or inactivated Malaria (e.g., P. falciparum, P. vivax, P. malariae and/or P. ovale), JEV, WNV, EEEV, VEEV, SINV, CHIKV, DENV, ZIKV and/or YFV vaccine.

In some embodiments, the effective amount of a tropical disease RNA (e.g., mRNA) vaccine is a dose equivalent to a 2 to 1000-, 2 to 900-, 2 to 800-, 2 to 700-, 2 to 600-, 2 to 500-, 2 to 400-, 2 to 300-, 2 to 200-, 2 to 100-, 2 to 90-, 2 to 80-, 2 to 70-, 2 to 60-, 2 to 50-, 2 to 40-, 2 to 30-, 2 to 20-, 2 to 10-, 2 to 9-, 2 to 8-, 2 to 7-, 2 to 6-, 2 to 5-, 2 to 4-, 2 to 3-, 3 to 1000-, 3 to 900-, 3 to 800-, 3 to 700-, 3 to 600-, 3 to 500-, 3 to 400-, 3 to 3 to 00-, 3 to 200-, 3 to 100-, 3 to 90-, 3 to 80-, 3 to 70-, 3 to 60-, 3 to 50-, 3 to 40-, 3 to 30-, 3 to 20-, 3 to 10-, 3 to 9-, 3 to 8-, 3 to 7-, 3 to 6-, 3 to 5-, 3 to 4-, 4 to 1000-, 4 to 900-, 4 to 800-, 4 to 700-, 4 to 600-, 4 to 500-, 4 to 400-, 4 to 4 to 00-, 4 to 200-, 4 to 100-, 4 to 90-, 4 to 80-, 4 to 70-, 4 to 60-, 4 to 50-, 4 to 40-, 4 to 30-, 4 to 20-, 4 to 10-, 4 to 9-, 4 to 8-, 4 to 7-, 4 to 6-, 4 to 5-, 4 to 4-, 5 to 1000-, 5 to 900-, 5 to 800-, 5 to 700-, 5 to 600-, 5 to 500-, 5 to 400-, 5 to 300-, 5 to 200-, 5 to 100-, 5 to 90-, 5 to 80-, 5 to 70-, 5 to 60-, 5 to 50-, 5 to 40-, 5 to 30-, 5 to 20-, 5 to 10-, 5 to 9- , 5 to 8-, 5 to 7-, 5 to 6-, 6 to 1000-, 6 to 900-, 6 to 800-, 6 to 700-, 6 to 600-, 6 to 500-, 6 to 400-, 6 to 300-, 6 to 200-, 6 to 100-, 6 to 90-, 6 to 80-, 6 to 70-, 6 to 60-, 6 to 50-, 6 to 40-, 6 to 30-, 6 to 20-, 6 to 10-, 6 to 9-, 6 to 8-, 6 to 7-, 7 to 1000-, 7 to 900-, 7 to 800-, 7 to 700-, 7 to 600-, 7 to 500-, 7 to 400-, 7 to 300-, 7 to 200-, 7 to 100-, 7 to 90-, 7 to 80-, 7 to 70-, 7 to 60-, 7 to 50-, 7 to 40-, 7 to 30-, 7 to 20-, 7 to 10-, 7 to 9-, 7 to 8-, 8 to 1000-, 8 to 900-, 8 to 800-, 8 to 700-, 8 to 600-, 8 to 500-, 8 to 400-, 8 to 300-, 8 to 200-, 8 to 100-, 8 to 90-, 8 to 80-, 8 to 70-, 8 to 60-, 8 to 50-, 8 to 40-, 8 to 30-, 8 to 20-, 8 to 10-, 8 to 9-, 9 to 1000-, 9 to 900-, 9 to 800-, 9 to 700-, 9 to 600-, 9 to 500-, 9 to 400-, 9 to 300-, 9 to 200-, 9 to 100-, 9 to 90-, 9 to 80-, 9 to 70-, 9 to 60-, 9 to 50-, 9 to 40-, 9 to 30-, 9 to 20-, 9 to 10-, 10 to 1000-, 10 to 900-, 10 to 800-, 10 to 700-, 10 to 600-, 10 to 500-, 10 to 400-, 10 to 300-, 10 to 200-, 10 to 100-, 10 to 90-, 10 to 80-, 10 to 70-, 10 to 60-, 10 to 50-, 10 to 40-, 10 to 30-, 10 to 20-, 20 to 1000-, 20 to 900-, 20 to 800-, 20 to 700-, 20 to 600-, 20 to 500-, 20 to 400-, 20 to 300-, 20 to 200-, 20 to 100-, 20 to 90-, 20 to 80-, 20 to 70-, 20 to 60-, 20 to 50-, 20 to 40-, 20 to 30-, 30 to 1000-, 30 to 900-, 30 to 800-, 30 to 700-, 30 to 600-, 30 to 500-, 30 to 400-, 30 to 300-, 30 to 200-, 30 to 100-, 30 to 90-, 30 to 80-, 30 to 70-, 30 to 60-, 30 to 50-, 30 to 40-, 40 to 1000-, 40 to 900-, 40 to 800-, 40 to 700-, 40 to 600-, 40 to 500-, 40 to 400-, 40 to 300-, 40 to 200-, 40 to 100-, 40 to 90-, 40 to 80-, 40 to 70-, 40 to 60-, 40 to 50-, 50 to 1000-, 50 to 900-, 50 to 800-, 50 to 700-, 50 to 600-, 50 to 500-, 50 to 400-, 50 to 300-, 50 to 200-, 50 to 100-, 50 to 90-, 50 to 80-, 50 to 70-, 50 to 60-, 60 to 1000-, 60 to 900-, 60 to 800-, 60 to 700-, 60 to 600-, 60 to 500-, 60 to 400-, 60 to 300-, 60 to 200-, 60 to 100-, 60 to 90-, 60 to 80-, 60 to 70-, 70 to 1000-, 70 to 900-, 70 to 800-, 70 to 700-, 70 to 600-, 70 to 500-, 70 to 400-, 70 to 300-, 70 to 200-, 70 to 100-, 70 to 90-, 70 to 80-, 80 to 1000-, 80 to 900-, 80 to 800-, 80 to 700-, 80 to 600-, 80 to 500-, 80 to 400-, 80 to 300-, 80 to 200-, 80 to 100-, 80 to 90-, 90 to 1000-, 90 to 900-, 90 to 800-, 90 to 700-, 90 to 600-, 90 to 500-, 90 to 400-, 90 to 300-, 90 to 200-, 90 to 100-, 100 to 1000-, 100 to 900-, 100 to 800-, 100 to 700-, 100 to 600-, 100 to 500-, 100 to 400-, 100 to 300-, 100 to 200-, 200 to 1000-, 200 to 900-, 200 to 800-, 200 to 700-, 200 to 600-, 200 to 500-, 200 to 400-, 200 to 300-, 300 to 1000-, 300 to 900-, 300 to 800-, 300 to 700-, 300 to 600-, 300 to 500-, 300 to 400-, 400 to 1000-, 400 to 900-, 400 to 800-, 400 to 700-, 400 to 600-, 400 to 500-, 500 to 1000-, 500 to 900-, 500 to 800-, 500 to 700-, 500 to 600-, 600 to 1000-, 600 to 900-, 600 to 800-, 600 to 700-, 700 to 1000-, 700 to 900-, 700 to 800-, 800 to 1000-, 800 to 900-, or 900 to 1000-fold reduction in the standard of care dose of a recombinant Malaria (e.g., *P. falciparum, P. vivax, P. malariae* and/or *P. ovale*), JEV, WNV, EEEV, VEEV, SINV, CHIKV, DENV, ZIKV and/or YFV protein vaccine. In some embodiments, the anti-antigenic polypeptide antibody titer produced in the subject is equivalent to an anti-antigenic polypeptide antibody titer produced in a control subject administered the standard of care dose of a recombinant or purified Malaria (e.g., *P. falciparum, P. vivax, P. malariae* and/or *P. ovale*), JEV, WNV, EEEV, VEEV, SINV, CHIKV, DENV, ZIKV and/or YFV protein vaccine or a live attenuated or inactivated Malaria (e.g., *P. falciparum, P. vivax, P. malariae* and/or *P. ovale*), JEV, WNV, EEEV, VEEV, SINV, CHIKV, DENV, ZIKV and/or YFV vaccine. In some embodiments, the effective amount is a dose equivalent to (or equivalent to an at least) 2-, 3-, 4-, 5-, 6-, 7-, 8-, 9-, 10-, 20-, 30-, 40-, 50-, 60-, 70-, 80-, 90-, 100-, 110-, 120-, 130-, 140-, 150-, 160-, 170-, 1280-, 190-, 200-, 210-, 220-, 230-, 240-, 250-, 260-, 270-, 280-, 290-, 300-, 310-, 320-, 330-, 340-, 350-, 360-, 370-, 380-, 390-, 400-, 410-, 420-, 430-, 440-, 450-, 4360-, 470-, 480-, 490-, 500-, 510-, 520-, 530-, 540-, 550-, 560-, 5760-, 580-, 590-, 600-, 610-, 620-, 630-, 640-, 650-, 660-, 670-, 680-, 690-, 700-, 710-, 720-, 730-, 740-, 750-, 760-, 770-, 780-, 790-, 800-, 810-, 820-, 830-, 840-, 850-, 860-, 870-, 880-, 890-, 900-, 910-, 920-, 930-, 940-, 950-, 960-, 970-, 980-, 990-, or 1000-fold reduction in the standard of care dose of a recombinant Malaria (e.g., *P. falciparum, P. vivax, P. malariae* and/or *P. ovale*), JEV, WNV, EEEV, VEEV, SINV, CHIKV, DENV, ZIKV and/or YFV protein vaccine. In some embodiments, an anti-antigenic polypeptide antibody titer produced in the subject is equivalent to an anti-antigenic polypeptide antibody titer produced in a control subject administered the standard of care dose of a recombinant or purified Malaria (e.g., *P. falciparum, P. vivax, P. malariae* and/or *P. ovale*), JEV, WNV, EEEV, VEEV, SINV, CHIKV, DENV, ZIKV and/or YFV protein vaccine or a live attenuated or inactivated Malaria (e.g., *P. falciparum, P. vivax, P. malariae* and/or *P. ovale*), JEV, WNV, EEEV, VEEV, SINV, CHIKV, DENV, ZIKV and/or YFV vaccine.

In some embodiments, the effective amount of a tropical disease RNA (e.g., mRNA) vaccine is a total dose of 50-1000 μg. In some embodiments, the effective amount of a tropical disease RNA (e.g., mRNA) vaccine is a total dose of 50-1000, 50-900, 50-800, 50-700, 50-600, 50-500, 50-400, 50-300, 50-200, 50-100, 50-90, 50-80, 50-70, 50-60, 60-1000, 60-900, 60-800, 60-700, 60-600, 60-500, 60-400, 60-300, 60-200, 60-100, 60-90, 60-80, 60-70, 70-1000, 70-900, 70-800, 70-700, 70-600, 70-500, 70-400, 70-300, 70-200, 70-100, 70-90, 70-80, 80-1000, 80-900, 80-800, 80-700, 80-600, 80-500, 80-400, 80-300, 80-200, 80-100, 80-90, 90-1000, 90-900, 90-800, 90-700, 90-600, 90-500, 90-400, 90-300, 90-200, 90-100, 100-1000, 100-900, 100-800, 100-700, 100-600, 100-500, 100-400, 100-300, 100-200, 200-1000, 200-900, 200-800, 200-700, 200-600, 200-500, 200-400, 200-300, 300-1000, 300-900, 300-800, 300-700, 300-600, 300-500, 300-400, 400-1000, 400-900, 400-800, 400-700, 400-600, 400-500, 500-1000, 500-900, 500-800, 500-700, 500-600, 600-1000, 600-900, 600-900, 600-700, 700-1000, 700-900, 700-800, 800-1000, 800-900, or 900-1000 μg. In some embodiments, the effective amount of a tropical disease RNA (e.g., mRNA) vaccine is a total dose of 50, 100, 150, 200, 250, 300, 350, 400, 450, 500, 550, 600, 650, 700, 750, 800, 850, 900, 950 or 1000 μg. In some embodiments, the effective amount is a dose of 25-500 μg administered to the subject a total of two times. In some embodiments, the effective amount of a tropical disease RNA (e.g., mRNA) vaccine is a dose of 25-500, 25-400, 25-300, 25-200, 25-100, 25-50, 50-500, 50-400, 50-300, 50-200, 50-100, 100-500, 100-400, 100-300, 100-200, 150-500, 150-400, 150-300, 150-200, 200-500, 200-400, 200-300, 250-500, 250-400, 250-300, 300-500, 300-400, 350-500, 350-400, 400-500 or 450-500 μs administered to the subject a total of two times. In some embodiments, the effective amount of a tropical disease RNA (e.g., mRNA) vaccine is a total dose of 25, 50, 100, 150, 200, 250, 300, 350, 400, 450, or 500 μg administered to the subject a total of two times.

Examples of Additional Embodiments of the Disclosure

1. A tropical disease vaccine, comprising:

at least one messenger ribonucleic acid (mRNA) polynucleotide having a 5' terminal cap, an open reading frame encoding at least one tropical disease antigenic polypeptide, and a 3' polyA tail.

2. The vaccine of paragraph 1, wherein the at least one tropical disease antigenic polypeptide is selected from a Malaria (e.g., *P. falciparum, P. vivax, P. malariae* and/or *P. ovale*) antigenic polypeptide, a JEV antigenic polypeptide, a WNV antigenic polypeptide, a EEEV antigenic polypeptide, a VEEV antigenic polypeptide, a SINV antigenic polypeptide, a CHIKV antigenic polypeptide, a DENV antigenic polypeptide, a ZIKV antigenic polypeptide and a YFV antigenic polypeptide.

3. The vaccine of paragraph 1, wherein the at least one mRNA polynucleotide is encoded by a sequence identified by any one of SEQ ID NO: 1-6, 18, 19, 30-34, 48, 49, 55, 56, 65-80, 118-136, 223-239 or 376-388, or a fragment of a sequence identified by any one of SEQ ID NO: 1-6, 18, 19, 30-34, 48, 49, 55, 56, 65-80, 118-136, 223-239 or 376-388.

4. The vaccine of paragraph 1, wherein the at least one mRNA polynucleotide comprises a sequence identified by any one of SEQ ID NO: 7-12, 20-21, 35-39, 50-51, 57-58, 81-96, 137-155, 240-256, or 389-401, or a fragment of a sequence identified by any one of SEQ ID NO: 7-12, 20-21, 35-39, 50-51, 57-58, 81-96, 137-155, 240-256, or 389-401.

5. The vaccine of paragraph 1, wherein the at least one antigenic polypeptide comprises a sequence identified by any one of SEQ ID NO: 13-17, 22-29, 44-47, 52-54, 59-64, 97-117, 156-222, 469, 259-291 or 402-413, or a fragment of a sequence identified by any one of SEQ ID NO: 13-17, 22-29, 44-47, 52-54, 59-64, 97-117, 156-222, 469, 259-291 or 402-413.

6. The vaccine of any one of paragraphs 1-5, wherein the 5' terminal cap is or comprises 7mG(5')ppp(5')NlmpNp.

7. The vaccine of any one of paragraphs 1-6, wherein 100% of the uracil in the open reading frame is modified to include N1-methyl pseudouridine at the 5-position of the uracil.

8. The vaccine of any one of paragraphs 1-7, wherein the vaccine is formulated in a lipid nanoparticle comprising: DLin-MC3-DMA; cholesterol; 1,2-Distearoyl-sn-glycero-3-phosphocholine (DSPC); and polyethylene glycol (PEG)2000-DMG.

9. The vaccine of paragraph 8, wherein the lipid nanoparticle further comprises trisodium citrate buffer, sucrose and water.

This disclosure is not limited in its application to the details of construction and the arrangement of components set forth in the following description or illustrated in the drawings. The disclosure is capable of other embodiments and of being practiced or of being carried out in various ways. Also, the phraseology and terminology used herein is for the purpose of description and should not be regarded as limiting. The use of "including," "comprising," or "having," "containing," "involving," and variations thereof herein, is meant to encompass the items listed thereafter and equivalents thereof as well as additional items.

EXAMPLES

Example 1

Manufacture of Polynucleotides

According to the present disclosure, the manufacture of polynucleotides and/or parts or regions thereof may be accomplished utilizing the methods taught in International Publication WO2014/152027, entitled "Manufacturing Methods for Production of RNA Transcripts," the contents of which is incorporated herein by reference in its entirety.

Purification methods may include those taught in International Publication WO2014/152030 and International Publication WO2014/152031, each of which is incorporated herein by reference in its entirety.

Detection and characterization methods of the polynucleotides may be performed as taught in International Publication WO2014/144039, which is incorporated herein by reference in its entirety.

Characterization of the polynucleotides of the disclosure may be accomplished using polynucleotide mapping, reverse transcriptase sequencing, charge distribution analysis, detection of RNA impurities, or any combination of two or more of the foregoing. "Characterizing" comprises determining the RNA transcript sequence, determining the purity of the RNA transcript, or determining the charge heterogeneity of the RNA transcript, for example. Such methods are taught in, for example, International Publication WO2014/144711 and International Publication WO2014/144767, the content of each of which is incorporated herein by reference in its entirety.

Example 2

Chimeric Polynucleotide Synthesis

According to the present disclosure, two regions or parts of a chimeric polynucleotide may be joined or ligated using triphosphate chemistry. A first region or part of 100 nucleotides or less is chemically synthesized with a 5' monophosphate and terminal 3'desOH or blocked OH, for example. If the region is longer than 80 nucleotides, it may be synthesized as two strands for ligation.

If the first region or part is synthesized as a non-positionally modified region or part using in vitro transcription (IVT), conversion the 5'monophosphate with subsequent capping of the 3' terminus may follow.

Monophosphate protecting groups may be selected from any of those known in the art.

The second region or part of the chimeric polynucleotide may be synthesized using either chemical synthesis or IVT methods. IVT methods may include an RNA polymerase that can utilize a primer with a modified cap. Alternatively, a cap of up to 130 nucleotides may be chemically synthesized and coupled to the IVT region or part.

For ligation methods, ligation with DNA T4 ligase, followed by treatment with DNase should readily avoid concatenation.

The entire chimeric polynucleotide need not be manufactured with a phosphate-sugar backbone. If one of the regions or parts encodes a polypeptide, then such region or part may comprise a phosphate-sugar backbone.

Ligation is then performed using any known click chemistry, orthoclick chemistry, solulink, or other bioconjugate chemistries known to those in the art.

Synthetic Route

The chimeric polynucleotide may be made using a series of starting segments. Such segments include:

(a) a capped and protected 5' segment comprising a normal 3'OH (SEG. 1)

(b) a 5' triphosphate segment, which may include the coding region of a polypeptide and a normal 3'OH (SEG. 2)

(c) a 5' monophosphate segment for the 3' end of the chimeric polynucleotide (e.g., the tail) comprising cordycepin or no 3'OH (SEG. 3)

After synthesis (chemical or IVT), segment 3 (SEG. 3) may be treated with cordycepin and then with pyrophosphatase to create the 5' monophosphate.

Segment 2 (SEG. 2) may then be ligated to SEG. 3 using RNA ligase. The ligated polynucleotide is then purified and treated with pyrophosphatase to cleave the diphosphate. The treated SEG.2-SEG. 3 construct may then be purified and SEG. 1 is ligated to the 5' terminus. A further purification step of the chimeric polynucleotide may be performed.

Where the chimeric polynucleotide encodes a polypeptide, the ligated or joined segments may be represented as: 5'UTR (SEG. 1), open reading frame or ORF (SEG. 2) and 3'UTR+PolyA (SEG. 3).

The yields of each step may be as much as 90-95%.

Example 3

PCR for cDNA Production

PCR procedures for the preparation of cDNA may be performed using 2× KAPA HIFI™ HotStart ReadyMix by Kapa Biosystems (Woburn, Mass.). This system includes 2× KAPA ReadyMix 12.5 µl; Forward Primer (10 µM) 0.75 µl; Reverse Primer (10 µM) 0.75 µl; Template cDNA 100 ng; and dH$_2$O diluted to 25.0 µl. The reaction conditions may be at 95° C. for 5 min. The reaction may be performed for 25 cycles of 98° C. for 20 sec, then 58° C. for 15 sec, then 72° C. for 45 sec, then 72° C. for 5 min, then 4° C. to termination.

The reaction may be cleaned up using Invitrogen's PURELINK™ PCR Micro Kit (Carlsbad, Calif.) per manufacturer's instructions (up to 5 µg). Larger reactions may require a cleanup using a product with a larger capacity. Following the cleanup, the cDNA may be quantified using the NANODROP™ and analyzed by agarose gel electrophoresis to confirm that the cDNA is the expected size. The cDNA may then be submitted for sequencing analysis before proceeding to the in vitro transcription reaction.

Example 4

In Vitro Transcription (IVT)

The in vitro transcription reaction generates RNA polynucleotides. Such polynucleotides may comprise a region or part of the polynucleotides of the disclosure, including chemically modified RNA (e.g., mRNA) polynucleotides. The chemically modified RNA polynucleotides can be uniformly modified polynucleotides. The in vitro transcription reaction utilizes a custom mix of nucleotide triphosphates (NTPs). The NTPs may comprise chemically modified NTPs, or a mix of natural and chemically modified NTPs, or natural NTPs.

A typical in vitro transcription reaction includes the following:

| | | |
|---|---|---|
| 1) | Template cDNA | 1.0 µg |
| 2) | 10× transcription buffer (400 mM Tris-HCl pH 8.0, 190 mM MgCl$_2$, 50 mM DTT, 10 mM Spermidine) | 2.0 µl |
| 3) | Custom NTPs (25 mM each) | 0.2 µl |
| 4) | RNase Inhibitor | 20 U |
| 5) | T7 RNA polymerase | 3000 U |
| 6) | dH$_2$0 | up to 20.0 µl. and |
| 7) | Incubation at 37° C. for 3 hr-5 hrs. | |

The crude IVT mix may be stored at 4° C. overnight for cleanup the next day. 1 U of RNase-free DNase may then be used to digest the original template. After 15 minutes of incubation at 37° C., the mRNA may be purified using Ambion's MEGACLEAR™ Kit (Austin, Tex.) following the manufacturer's instructions. This kit can purify up to 500 µg of RNA. Following the cleanup, the RNA polynucleotide may be quantified using the NANODROP™ and analyzed by agarose gel electrophoresis to confirm the RNA polynucleotide is the proper size and that no degradation of the RNA has occurred.

Example 5

Enzymatic Capping

Capping of a RNA polynucleotide is performed as follows where the mixture includes: IVT RNA 60 µg-180 µg and dH$_2$O up to 72 µl. The mixture is incubated at 65° C. for 5 minutes to denature RNA, and then is transferred immediately to ice.

The protocol then involves the mixing of 10× Capping Buffer (0.5 M Tris-HCl (pH 8.0), 60 mM KCl, 12.5 mM MgCl$_2$) (10.0 µl); 20 mM GTP (5.0 µl); 20 mM S-Adenosyl Methionine (2.5 µl); RNase Inhibitor (100 U); 2'-O-Methyltransferase (400 U); Vaccinia capping enzyme (Guanylyl transferase) (40 U); dH$_2$O (Up to 28 µl); and incubation at 37° C. for 30 minutes for 60 µg RNA or up to 2 hours for 180 µg of RNA.

The RNA polynucleotide may then be purified using Ambion's MEGACLEAR™ Kit (Austin, Tex.) following the manufacturer's instructions. Following the cleanup, the RNA may be quantified using the NANODROP™ (ThermoFisher, Waltham, Mass.) and analyzed by agarose gel electrophoresis to confirm the RNA polynucleotide is the proper size and that no degradation of the RNA has occurred. The RNA polynucleotide product may also be sequenced by running a reverse-transcription-PCR to generate the cDNA for sequencing.

Example 6

PolyA Tailing Reaction

Without a poly-T in the cDNA, a poly-A tailing reaction must be performed before cleaning the final product. This is done by mixing capped IVT RNA (100 µl); RNase Inhibitor (20 U); 10× Tailing Buffer (0.5 M Tris-HCl (pH 8.0), 2.5 M NaCl, 100 mM MgCl$_2$) (12.0 µl); 20 mM ATP (6.0 µl); Poly-A Polymerase (20 U); dH$_2$O up to 123.5 µl and incubation at 37° C. for 30 min. If the poly-A tail is already in the transcript, then the tailing reaction may be skipped and proceed directly to cleanup with Ambion's MEGACLEAR™ kit (Austin, Tex.) (up to 500 µg). Poly-A Polymerase may be a recombinant enzyme expressed in yeast.

It should be understood that the processivity or integrity of the polyA tailing reaction may not always result in an exact size polyA tail. Hence, polyA tails of approximately between 40-200 nucleotides, e.g., about 40, 50, 60, 70, 80, 90, 91, 92, 93, 94, 95, 96, 97, 98, 99, 100, 101, 102, 103, 104, 105, 106, 107, 108, 109, 110, 150-165, 155, 156, 157, 158, 159, 160, 161, 162, 163, 164 or 165 are within the scope of the present disclosure.

Example 7

Natural 5' Caps and 5' Cap Analogues

5'-capping of polynucleotides may be completed concomitantly during the in vitro-transcription reaction using the following chemical RNA cap analogs to generate the 5'-guanosine cap structure according to manufacturer protocols: 3'-O-Me-m7G(5)ppp(5') G [the ARCA cap]; G(5') ppp(5')A; G(5')ppp(5')G; m7G(5')ppp(5')A; m7G(5')ppp (5')G (New England BioLabs, Ipswich, Mass.). 5'-capping of modified RNA may be completed post-transcriptionally using a Vaccinia Virus Capping Enzyme to generate the "Cap 0" structure: m7G(5')ppp(5')G (New England BioLabs, Ipswich, Mass.). Cap 1 structure may be generated using both Vaccinia Virus Capping Enzyme and a 2'-O methyl-transferase to generate: m7G(5')ppp(5')G-2'-O-methyl. Cap 2 structure may be generated from the Cap 1 structure followed by the 2'-O-methylation of the 5'-antepenultimate nucleotide using a 2'-O methyl-transferase. Cap 3 structure may be generated from the Cap 2 structure followed by the 2'-O-methylation of the 5'-preantepenultimate nucleotide using a 2'-O methyl-transferase. Enzymes are preferably derived from a recombinant source.

When transfected into mammalian cells, the modified mRNAs have a stability of between 12-18 hours or more than 18 hours, e.g., 24, 36, 48, 60, 72 or greater than 72 hours.

Example 8

Capping Assays

Protein Expression Assay

Polynucleotides (e.g., mRNA) encoding a polypeptide, containing any of the caps taught herein, can be transfected into cells at equal concentrations. The amount of protein secreted into the culture medium can be assayed by ELISA at 6, 12, 24 and/or 36 hours post-transfection. Synthetic polynucleotides that secrete higher levels of protein into the medium correspond to a synthetic polynucleotide with a higher translationally-competent cap structure.

Purity Analysis Synthesis

RNA (e.g., mRNA) polynucleotides encoding a polypeptide, containing any of the caps taught herein can be compared for purity using denaturing Agarose-Urea gel electrophoresis or HPLC analysis. RNA polynucleotides with a single, consolidated band by electrophoresis correspond to the higher purity product compared to polynucleotides with multiple bands or streaking bands. Chemically modified RNA polynucleotides with a single HPLC peak also correspond to a higher purity product. The capping reaction with a higher efficiency provides a more pure polynucleotide population.

Cytokine Analysis

RNA (e.g., mRNA) polynucleotides encoding a polypeptide, containing any of the caps taught herein can be transfected into cells at multiple concentrations. The amount of pro-inflammatory cytokines, such as TNF-alpha and IFN-beta, secreted into the culture medium can be assayed by ELISA at 6, 12, 24 and/or 36 hours post-transfection. RNA polynucleotides resulting in the secretion of higher levels of pro-inflammatory cytokines into the medium correspond to a polynucleotides containing an immune-activating cap structure.

Capping Reaction Efficiency

RNA (e.g., mRNA) polynucleotides encoding a polypeptide, containing any of the caps taught herein can be analyzed for capping reaction efficiency by LC-MS after nuclease treatment. Nuclease treatment of capped polynucleotides yield a mixture of free nucleotides and the capped 5'-5-triphosphate cap structure detectable by LC-MS. The amount of capped product on the LC-MS spectra can be expressed as a percent of total polynucleotide from the reaction and correspond to capping reaction efficiency. The cap structure with a higher capping reaction efficiency has a higher amount of capped product by LC-MS.

Example 9

Agarose Gel Electrophoresis of Modified RNA or RT PCR Products

Individual RNA polynucleotides (200-400 ng in a 20 µl volume) or reverse transcribed PCR products (200-400 ng) may be loaded into a well on a non-denaturing 1.2% Agarose E-Gel (Invitrogen, Carlsbad, Calif.) and run for 12-15 minutes, according to the manufacturer protocol.

Example 10

NANODROP™ Modified RNA Quantification and UV Spectral Data

Chemically modified RNA polynucleotides in TE buffer (1 µl) are used for NANODROP™ UV absorbance readings to quantitate the yield of each polynucleotide from an chemical synthesis or in vitro transcription reaction.

Example 11

Formulation of Modified mRNA Using Lipidoids

RNA (e.g., mRNA) polynucleotides may be formulated for in vitro experiments by mixing the polynucleotides with the lipidoid at a set ratio prior to addition to cells. In vivo formulation may require the addition of extra ingredients to facilitate circulation throughout the body. To test the ability of these lipidoids to form particles suitable for in vivo work, a standard formulation process used for siRNA-lipidoid formulations may be used as a starting point. After formation of the particle, polynucleotide is added and allowed to integrate with the complex. The encapsulation efficiency is determined using a standard dye exclusion assays.

Example 12

Immunogenicity Study

The instant study is designed to test the immunogenicity in mice of candidate Malaria vaccines comprising a mRNA polynucleotide encoding CS protein, LSA1, MSP1, AMA1, TRAP or a combination thereof obtained from Plasmodium.

Mice are immunized intramuscularly (IM), or intradermally (ID) with mRNA encoding CS protein, LSA1, MSP1, TRAP and AMA1. Up to three immunizations are given at 3-week intervals (i.e., at weeks 0, 3, and 6), and sera are collected after each immunization until weeks 33-51. Serum antibody titers against CS protein, LSA1, MSP1 and AMA1 are determined by ELISA. Responses against Plasmodium sporozoites, asexual blood-stage parasites, and gametocytes were determined by using an indirect immunofluorescence assay (IFA). T cell responses were analyzed by Elispot using splenocytes from immunized mice and stimulated with peptide pools from the relevant antigens.

Example 13

Plasmodium Non Human Primate Challenge

The instant study is designed to test the efficacy in simians of candidate Malaria vaccines against a lethal challenge using a Malaria vaccine comprising mRNA encoding CS protein, LSA1, MSP1, AMA1, TRAP or a combination thereof obtained from *Plasmodium*. Simians are challenged with a lethal dose of *Plasmodium*.

Simians are immunized intramuscularly (IM) or intradermally (ID) at week 0, week 3 and week 6 with candidate Malaria vaccines.

Serum antibody titers against CS protein, LSA1, MSP1 and AMA1 are determined by ELISA. Responses against *Plasmodium* sporozoites, asexual blood-stage parasites, and gametocytes were determined by using an indirect immunofluorescence assay (IFA). T cell responses were analyzed by Elispot using PBMCs from immunized primates and stimulated with peptide pools from the relevant antigens.

In experiments where a lipid nanoparticle (LNP) formulation is used, the formulation may include a cationic lipid, non-cationic lipid, PEG lipid and structural lipid in the ratios 50:10:1.5:38.5. The cationic lipid may be DLin-KC2-DMA (50 mol %), the non-cationic lipid may be DSPC (10 mol %), the PEG lipid may be PEG-DOMG (1.5 mol %) and the structural lipid may be cholesterol (38.5 mol %), for example.

Example 14

Plasmodium Human Challenge

The instant study is designed to test the efficacy in human subjects of candidate Malaria vaccines against an attenuated challenge (Controlled Human Malaria Infection (CHMI) Study) using a Malaria vaccine comprising mRNA encoding CS protein, LSA1, MSP1, AMA1, TRAP or a combination thereof obtained from *Plasmodium*. Subjects are challenged with an attenuated (non-lethal) dose of *Plasmodium*.

Subjects are immunized intramuscularly (IM) or intradermally (ID) at week 0 and week 3 with candidate Malaria vaccines. Serum is tested for microneutralization (see Example 16). The subjects are then challenged with an attenuated dose of *Plasmodium* on week 7 via IV, IM or ID. Endpoint is day 13 post infection. Body temperature and weight are assessed and recorded daily.

In experiments where a lipid nanoparticle (LNP) formulation is used, the formulation may include a cationic lipid, non-cationic lipid, PEG lipid and structural lipid in the ratios 50:10:1.5:38.5. The cationic lipid may be DLin-KC2-DMA (50 mol %), the non-cationic lipid may be DSPC (10 mol %), the PEG lipid may be PEG-DOMG (1.5 mol %) and the structural lipid may be cholesterol (38.5 mol %), for example.

Example 15

Microneutralization Assay

Nine serial 2-fold dilutions (1:50-1:12,800) of simian or human serum are made in 50 μl virus growth medium (VGM) with trypsin in 96 well microtiter plates. Fifty microliters of *Plasmodium* are added to the serum dilutions and allowed to incubate for 60 minutes at room temperature (RT). Positive control wells of *Plasmodium* without sera and negative control wells without *Plasmodium* or sera are included in triplicate on each plate. While the serum-*Plasmodium* mixtures incubate, a single cell suspension of cells is prepared by trypsinizing (Gibco 0.5% bovine pancrease trypsin in EDTA) a confluent monolayer, and suspended cells are transferred to a 50 ml centrifuge tube, topped with sterile PBS and gently mixed. The cells are then pelleted at 200 g for 5 minutes, supernatant aspirated and cells resuspended in PBS. This procedure is repeated once and the cells are resuspended at a concentration of $3\times10^5$/ml in VGM with porcine trypsin. Then, 100 μl of cells are added to the serum-virus mixtures and the plates incubated at 35° C. in $CO_2$ for 5 days. The plates are fixed with 80% acetone in phosphate buffered saline (PBS) for 15 minutes at RT, air dried and then blocked for 30 minutes containing PBS with 0.5% gelatin and 2% FCS. An antibody to CS protein, LSA1, MSP1, AMA1 or TRAP is diluted in PBS with 0.5% gelatin/2% FCS/0.5% Tween 20 and incubated at RT for 2 hours. Wells are washed and horse radish peroxidase conjugated goat anti-mouse IgG added, followed by another 2 hour incubation. After washing, 0-phenylenediamine dihydrochloride is added and the neutralization titer is defined as the titer of serum that reduced color development by 50% compared to the positive control wells.

Example 16

JEV Immunogenicity Study

This study was designed to test the immunogenicity of JEV prME mRNA vaccines in Balb/c mice. Mice were 6-8 weeks old.

Mice were immunized intramuscularly at three different doses (10 μg, 2 μg and 0.5 μg). All mice were given two doses of the vaccine, one at day 0 and another at day 28. Serum was collected at days 0 and 56, and a plaque reduction neutralization test was used to quantify neutralizing antibody titer. The concentration of serum to reduce the number of plaques in the assay by 50%, compared to the serum free virus, denoted as PRNT50 was used as a measure of neutralizing antibodies and level of protection against virus.

Results of this study is shown in FIG. 1. A PRNT50 titer of greater than 1:10 is considered protective. JEV mRNA vaccine at 10 μg doses results in a very high titer, indicative of a high potency vaccine.

Example 17

Immunogenicity Cross-Neutralization Study

The instant study is designed to test the immunogenicity and cross-neutralization in mice of candidate combination vaccines comprising a mRNA polynucleotide encoding antigenic polypeptides (e.g., envelope proteins) obtained from *Plasmodium*, JEV, WNV, EEEV, VEEV, SINV, CHIKV, DENV, ZIKV and/or YFV.

Mice are immunized intravenously (IV), intramuscularly (IM), or intradermally (ID) with candidate combination vaccines. A total of four immunizations are given at 3-week intervals (at weeks 0, 3, 6, and 9), and sera are collected after each immunization until weeks 33-51. Serum antibody titers against envelope proteins are determined by ELISA. Sera collected from each mouse during weeks 10-16 are pooled, and total IgGs are purified by using ammonium sulfate (Sigma) precipitation followed by DEAE (Pierce) batch purification. Following dialysis against PBS, the purified antibodies are used for immunoelectron microscopy, antibody-affinity testing, and an in vitro protection assay.

Example 18

Immunogenicity Studies for Combination RNA Vaccine

BALB/C mice are immunized with mRNA encoded *Plasmodium*, JEV, WNV, EEEV, VEEV, SINV, CHIKV, DENV, ZIKV and/or YFV antigenic polypeptides, for example, as shown in Table 7 below and according to the following dosing/bleeding schedule: prime dose on day 0, boost dose on day 28, bleeding on days 0, 28, 42 and 56.

The mice are administered a combination vaccine, combining two or more of the *Plasmodium*, JEV, WNV, EEEV, VEEV, SINV, CHIKV, DENV, ZIKV and/or YFV antigenic polypeptides, such that all possible combinations are tested. Animals are challenged at day 56 with a second dose of any one of the antigenic polypeptides included in the original dose.

An efficacy study using mRNA encoded West Nile prMEs and Japanese Encephalitis prMEs antigens is also performed according to the following schedule:

Non-human primates are also immunized with mRNA encoded antigen using similar schedules shown in Tables 7 and 8. The animals are tested for immunogenicity to *Plasmodium*, JEV, WNV, EEEV, VEEV, SINV, CHIKV, DENV, ZIKV and/or YFV and combinations thereof.

Example 19

YFV Immunogenicity Studies

The instant study is designed to test the immunogenicity in Balb/c mice of candidate yellow fever virus (YFV) vaccines comprising a mRNA polynucleotide encoding YFV prME. Four groups of Balb/c mice (n=5) are immunized intramuscularly (IM) with 10 μg (n=2) or 2 μg (n=2) of the candidate vaccine. One group of mice is administered PBS intramuscularly as a control. All mice are administered an initial dose of vaccine (Groups 1-4) or PBS (Group 5) on Day 0, and then the mice in Groups 1 and 3 are administered a boost dose on Day 21, while the mice in Group 5 are administered PBS on Day 21. All mice are bled on Day 41. See Table 1. Anti-Yellow fever neutralization IgG titer is determined on Day −1, Day 28 and Day 41.

Example 20

YFV Rodent Challenge

The instant study is designed to test the efficacy in AG129 mice of candidate yellow fever virus (YFV) vaccines against a lethal challenge using a YFV vaccine comprising mRNA encoding YFV prME. Four groups of AG129 mice (n=8) are immunized intramuscularly (IM) with 10 μg (n=2) or 2 μg (n=2) of the candidate vaccine. One group of mice is administered PBS intramuscularly as a control. All mice are administered an initial dose of vaccine (Groups 1-4) or PBS (Group 5) on Day 0, and then the mice in Groups 1 and 3 are administered a boost dose on Day 21, while the mice in Group 5 are administered PBS on Day 21. All mice are challenged with a lethal dose of YFV in Day 42. All mice are then monitored for survival and weight loss. Anti-Yellow fever neutralization IgG titer is determined on Day −1, Day 28 and Day 41, and viral load is determined 5 days post challenge.

Example 21

Expression of ZIKV prME Protein in Mammalian Cells Using ZIKV mRNA Vaccine Construct The Zika virus (ZIKV) prME mRNA vaccine construct were tested in mammalian cells (239T cells) for the expression of ZIKV prME protein. 293T cells were plated in 24-well plates and were transfected with 2 μg of ZIKV prME mRNA using a Lipofectamine transfection reagent. The cells were incubated for the expression of the ZIKV prME proteins before they were lysed in an immunoprecipitation buffer containing protease inhibitor cocktails. Reducing agent was not added to the lysis buffer to ensure that the cellular proteins were in a non-reduced state. Cell lysates were centrifuged at 8,000×g for 20 mins to collect lysed cell precipitate. The cell precipitates were then stained with anti ZIKV human serum and goat anti-human Alexa Fluor 647. Fluorescence was detected as an indication of prME expression.

Figure 2:
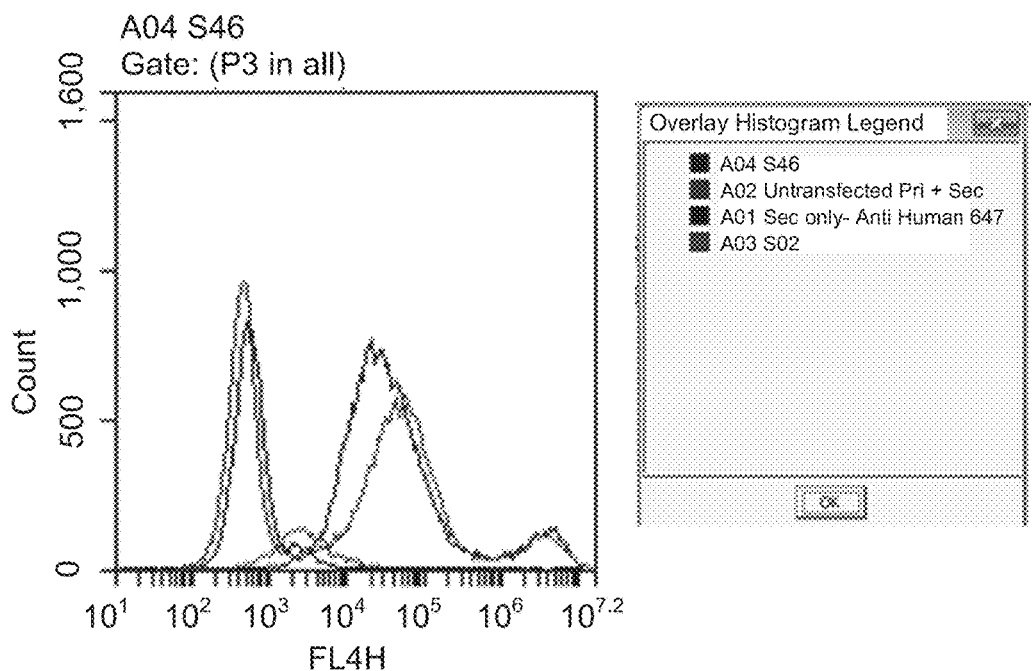
FIG. 2 shows a histogram indicating intracellular detection of ZIKA prME protein using human serum containing anti-ZIKV antigen antibodies.
Figure 3:
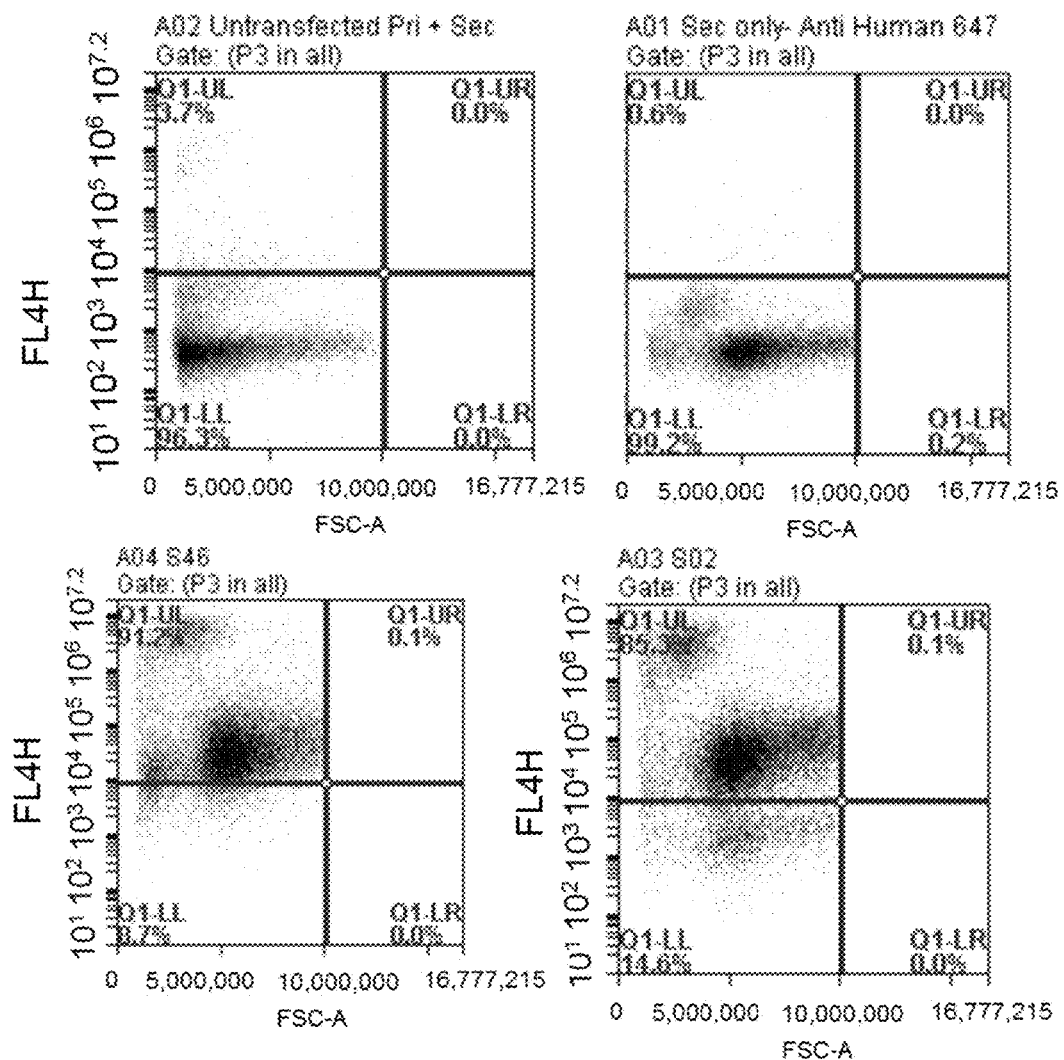
FIG. 3 shows the results of detecting prME protein expression in mammalian cells with fluorescence-activated cell sorting (FACS) using a flow cytometer. Cells expressing prME showed higher fluorescence intensity when stained with anti-ZIKV human serum.
Figure 6:
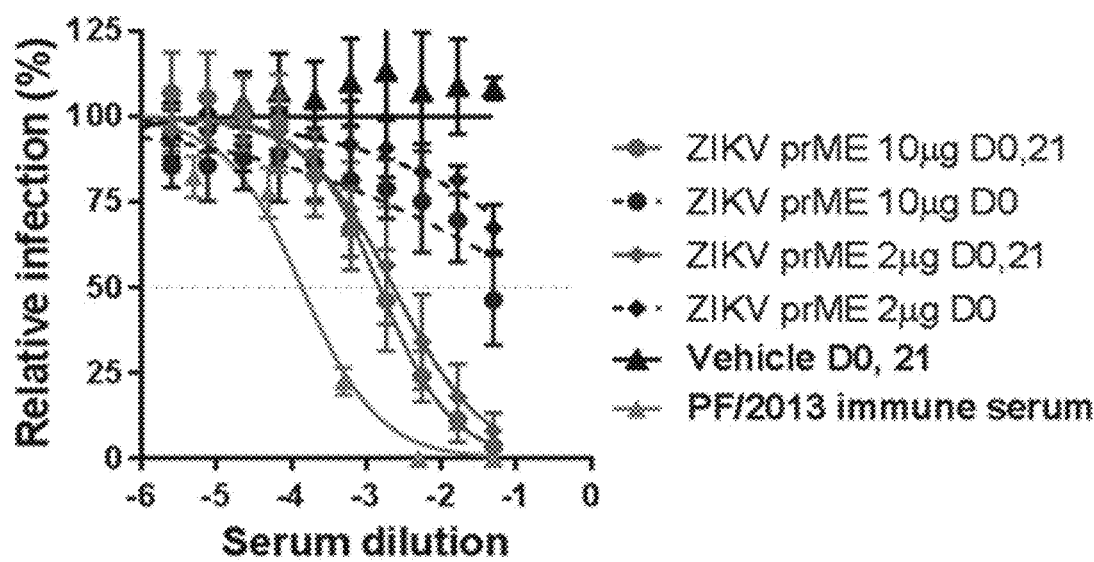
FIG. 6 shows a graph of neutralizing titers obtained from BALB/c mice immunized with a ZIKV mRNA vaccine encoding prME.

The expression of ZIKV prME protein was also detected by fluorescence-activated cell sorting (FACS) using a flow cytometer. 293F cells ($2\times10^6$ cells/ml, 30 ml) were transfected with 120 μg PEI, 1 ml of 150 mM NaCl, and 60 μg prME mRNA. Transfected cells were incubated for 48 hours at 37° C. in a shaker at 130 rpm and under 5% $CO_2$. The cells were then washed with PBS buffer containing 2% FBS and fixed in a fixation buffer (PBS buffer containing formalin) for 20 minutes at room temperature. The fixed cells were permeabilized in a permeabilization buffer (PBS+1% Triton X100+1 μl of Golgi plug/ml of cells). The permeabilized cells were then stained with anti-ZIKV human serum (1:20 dilution) and goat anti-human Alexa Fluor 647 secondary antibody, before they were sorted on a flow cytometer. As shown in FIG. 2, FIG. 3A and FIG. 3B, cells transfected with prME mRNA and stained with the anti-ZIKA human serum shifted to higher fluorescent intensity, indicating that prME expressed from the ZIKV mRNA vaccine constructs in the transfected cells.

Example 22

Expression, Purification and Characterization of ZIKV VLPs

Zika virus (ZIKV) virus-like particles (VLPs) were made in HeLa cells and in HEK293T cells and purified via PEG precipitation or ultracentrifugation, respectively. Cells were cultured in culture media. Prior to transfection, cells were passaged twice in virus growth media plus 10% fetal bovine serum (FBS) to media adaptation.

Cells were seeded the day before transfection into T-175 flask. 100 μg of prME-encoding mRNA was transfected using 100 μg pf lipofectamine as per manufacturer's protocol. 6 hours post transfection, monolayers were washed twice with 1×PBS and 20 mL of virus growth media was added. Supernatant was collected 24-48 hours post transfection by centrifugation at 2000×g for 10 mins and 0.22 μm filtration.

For VLP purification via PEG precipitation, VLP's were concentrated using Biovision PEG precipitation kit as per manufacturer's protocol. In brief, supernatant with VLP's was mixed with PEG8000 and incubated at 4° C. for 16 hours. After incubation, mixture was centrifuged at 3000×g for 30 mins Pellet containing concentrated VLP's was collected and suspended into PBS. VLP's were further buffer exchanged into PBS (1:500) using amicon ultra 100MWCO filter. Purified samples were negative stained to show the presence of assembled VLP particles.

Expression of prME from the vaccine mRNA constructs was demonstrated to result in the production of virus like particles (VLPs) that are expected to present to the immune system as identical to Zika virus particles. Negative stain electron micrographs of supernatants from HeLa cells transfected with mRNA encoding Zika prME showed that the virus-like particles (VLPs), purified by PEG precipitation, have highly uniform size (~35-40 nm) and morphology. The bumpy appearance of the VLP surface appears to reflect mostly immature morphology due to expression from HeLa cells, which have very low expression of furin, a host protease that is required for maturation the viral envelope. Upon maturation, these VLPs will have an exterior structure essentially identical to wild type viral particles, thus eliciting a broad immune response to future Zika virus exposure.

For VLP purification via ultracentrifugation, 293T cells were transfected with Zika prME mRNA as described herein. Supernatant was collected 24 hours after changing the media as described herein (30 hours post transfection). VLPs were concentrated using Biovision PEG virus precipitation kit into 500 μL volume. VLPs were further purified using a 10-50% sucrose gradient. Sample layer was seen between 20-30% sucrose layers and collected. VLPs were buffered exchanged into PBS by 1:1000 dilution using a 100MWCO amicon ultra filter. VLPs were concentrated after PEG precipitation, and ultracentrifuge-purified VLPs were analyzed for purity on a reducing SDS-PAGE gel (FIG. 4).

Example 23

ZIKV mRNA Vaccine Immunogenicity Studies

The instant study was designed to test the immunogenicity in Balb/c mice of candidate ZIKV vaccines comprising a mRNA polynucleotide encoding ZIKV prME. Four groups of Balb/c mice (n=5) were immunized intramuscularly (IM) with 10 μg (n=2) or 2 μg (n=2) of the candidate vaccine. One group of mice was administered PBS intramuscularly as a control. All mice were administered an initial dose of vaccine (Groups 1-4) or PBS (Group 5) on Day 0, and then the mice in Groups 1 and 3 were administered a boost dose on Day 21, while the mice in Group 5 were administered PBS on Day 21. All mice were bled on Day 41. See Table 29. Anti-Zika neutralization IgG titer was determined on Day −1, Day 28 and Day 41 (FIG. 5).

Day 42 neutralizing titers reached EC50s of 427 for 2 μg and 690 for 10 μg. The control serum in this experiment was from naturally infected immunocompromised mice (Ifnar1−/−, derived from B/6 lineage) in which high viral loads would be achieved.

Example 24

ZIKV Rodent Challenge

Figure 7A:
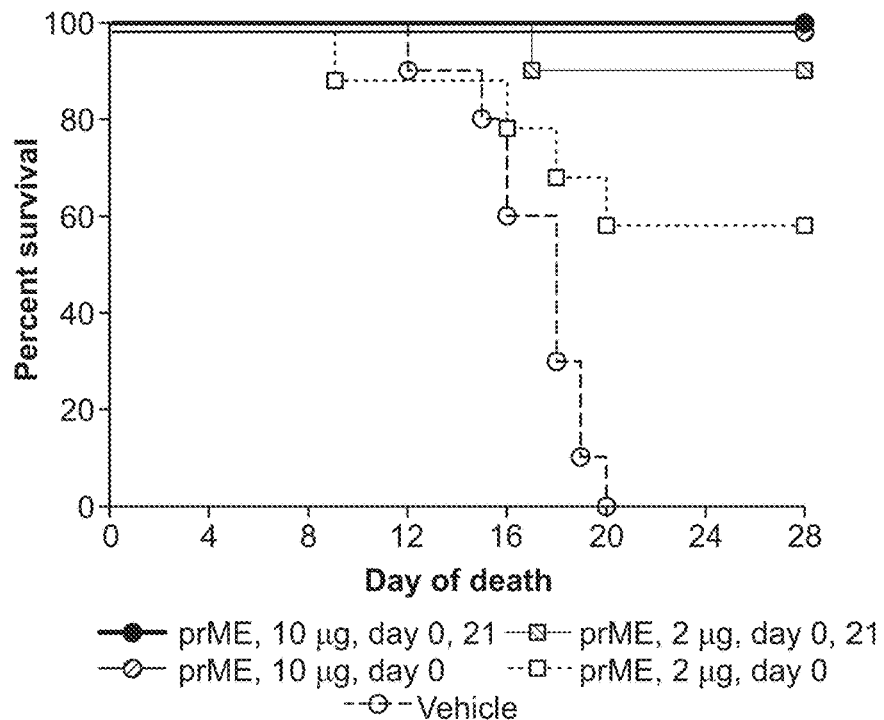
FIGS. 7A-7B show percent animal survival (FIG. 7A) and percent weight change (FIG. 7B) in animals following administration of two different doses of a ZIKV RNA vaccine comprising mRNA encoding ZIKV prME.
Figure 7B:
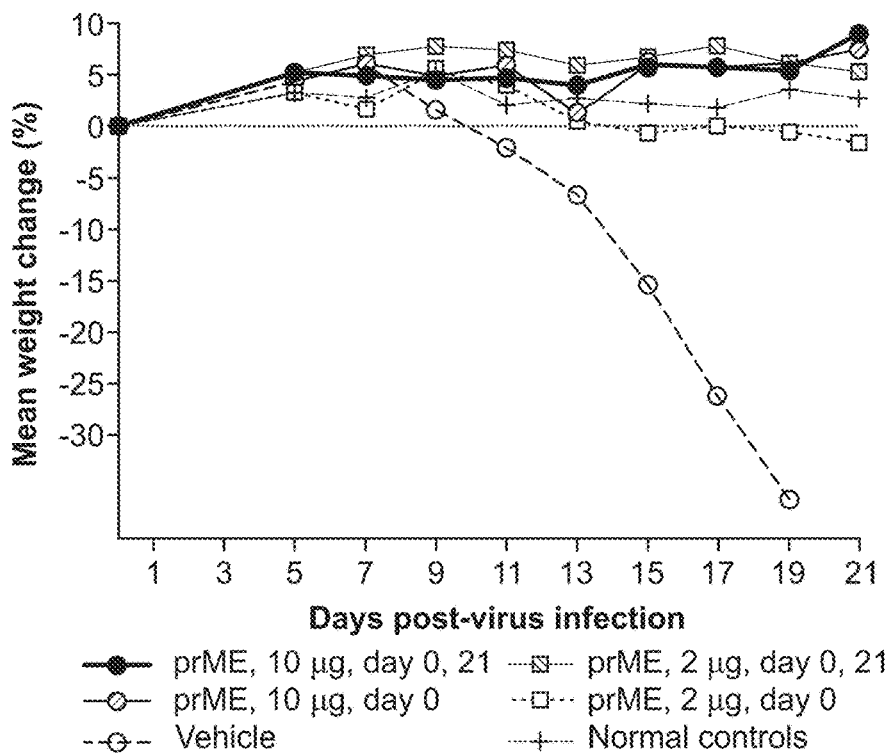
Figure 8A:
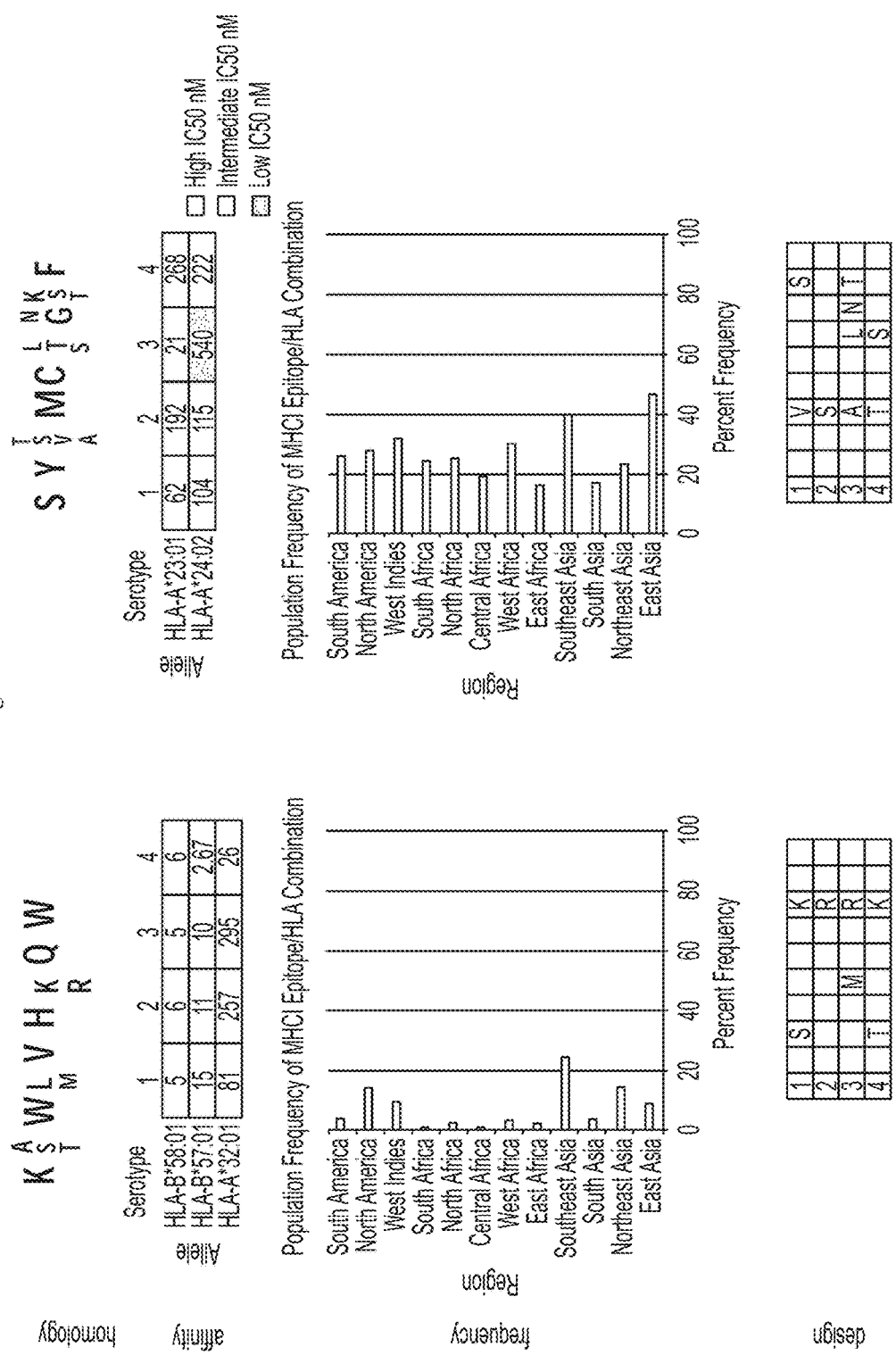
Figure 8B:
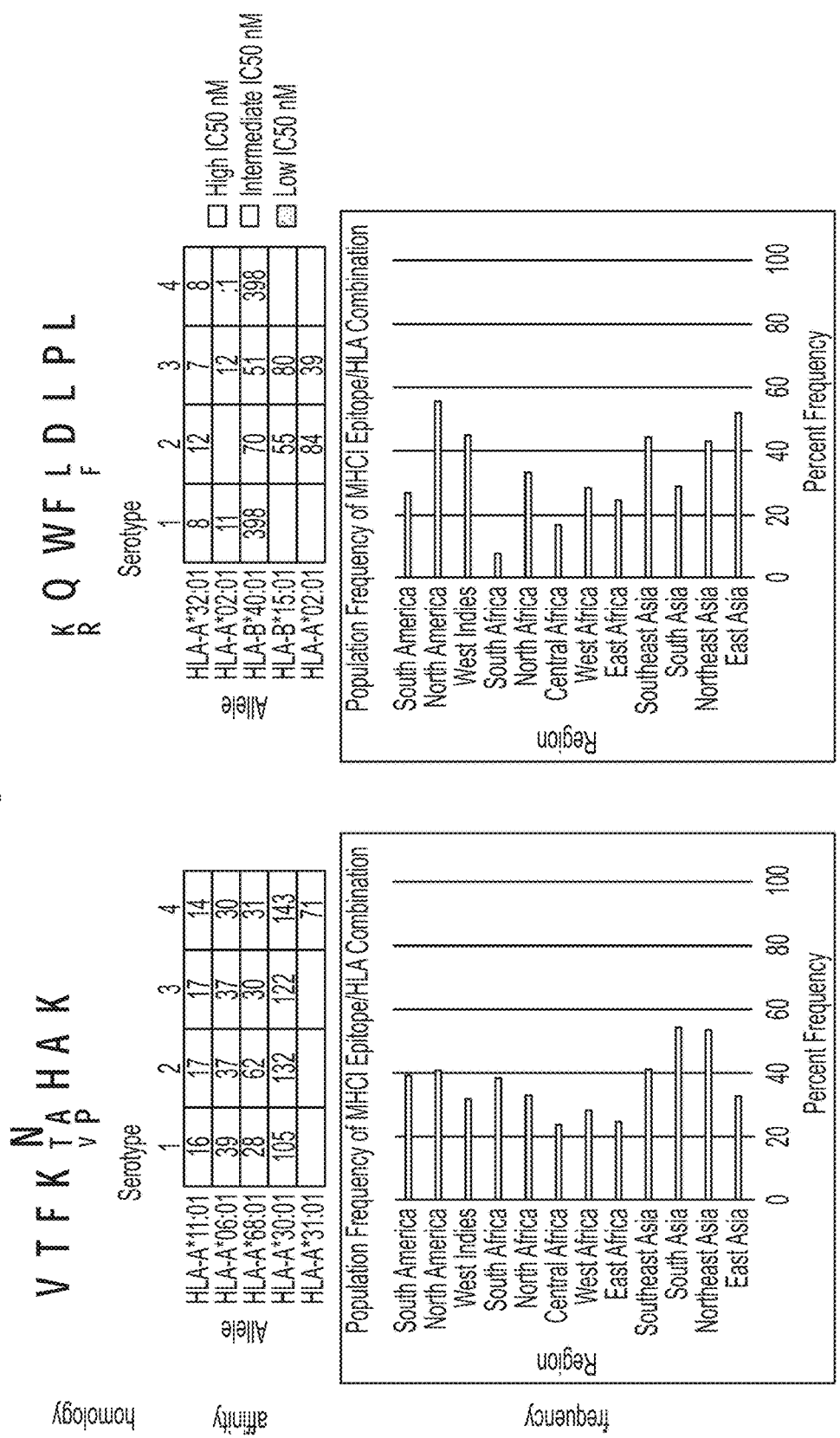
Figure 9A:
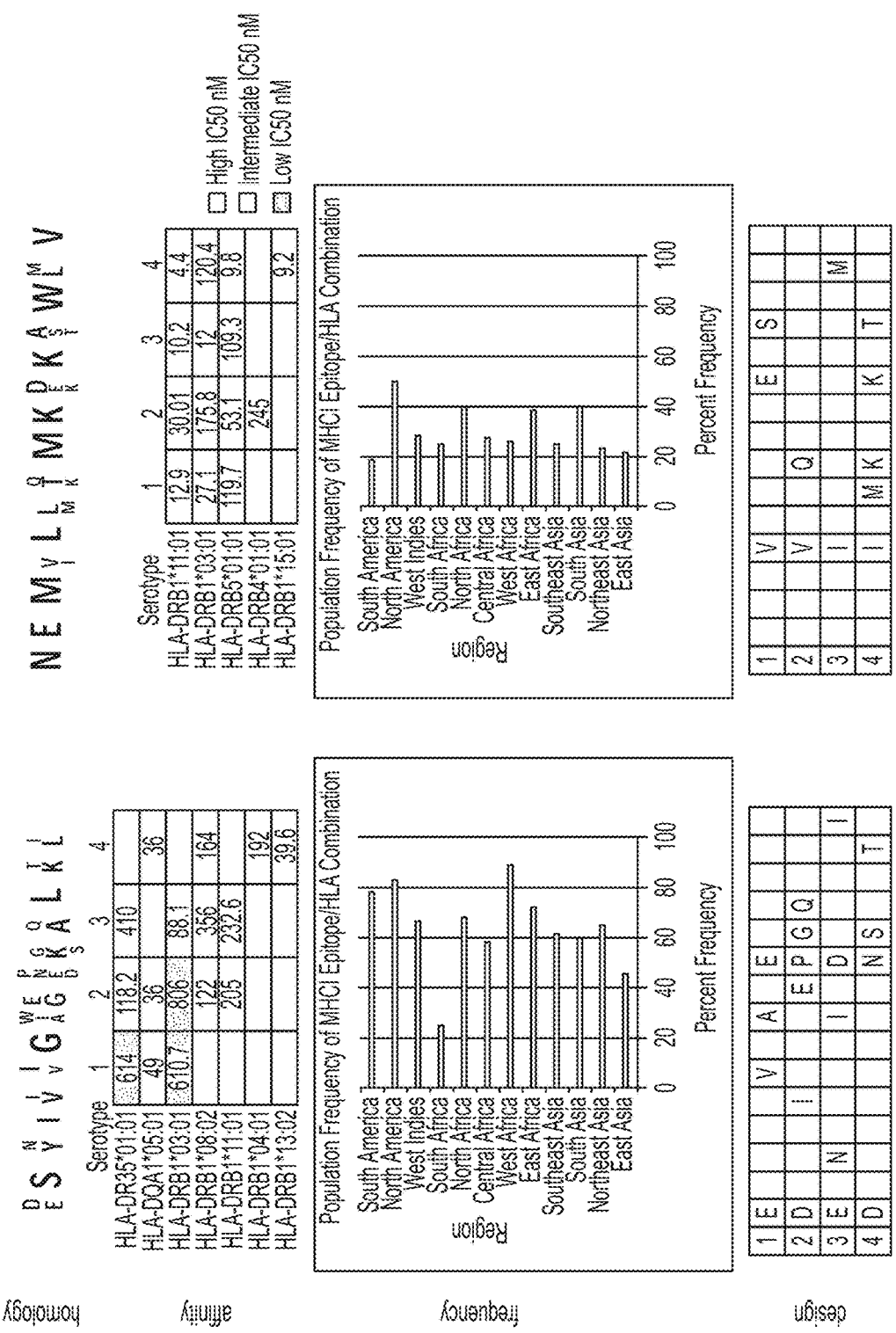
FIGS. 9A-9C show Dengue Virus MHC II T cell epitopes. The sequences, from left to right, correspond to SEQ ID NO: 371-372 (FIG. 9A), 373-374 (FIG. 9B), and 375 (FIG. 9C).
Figure 9B:
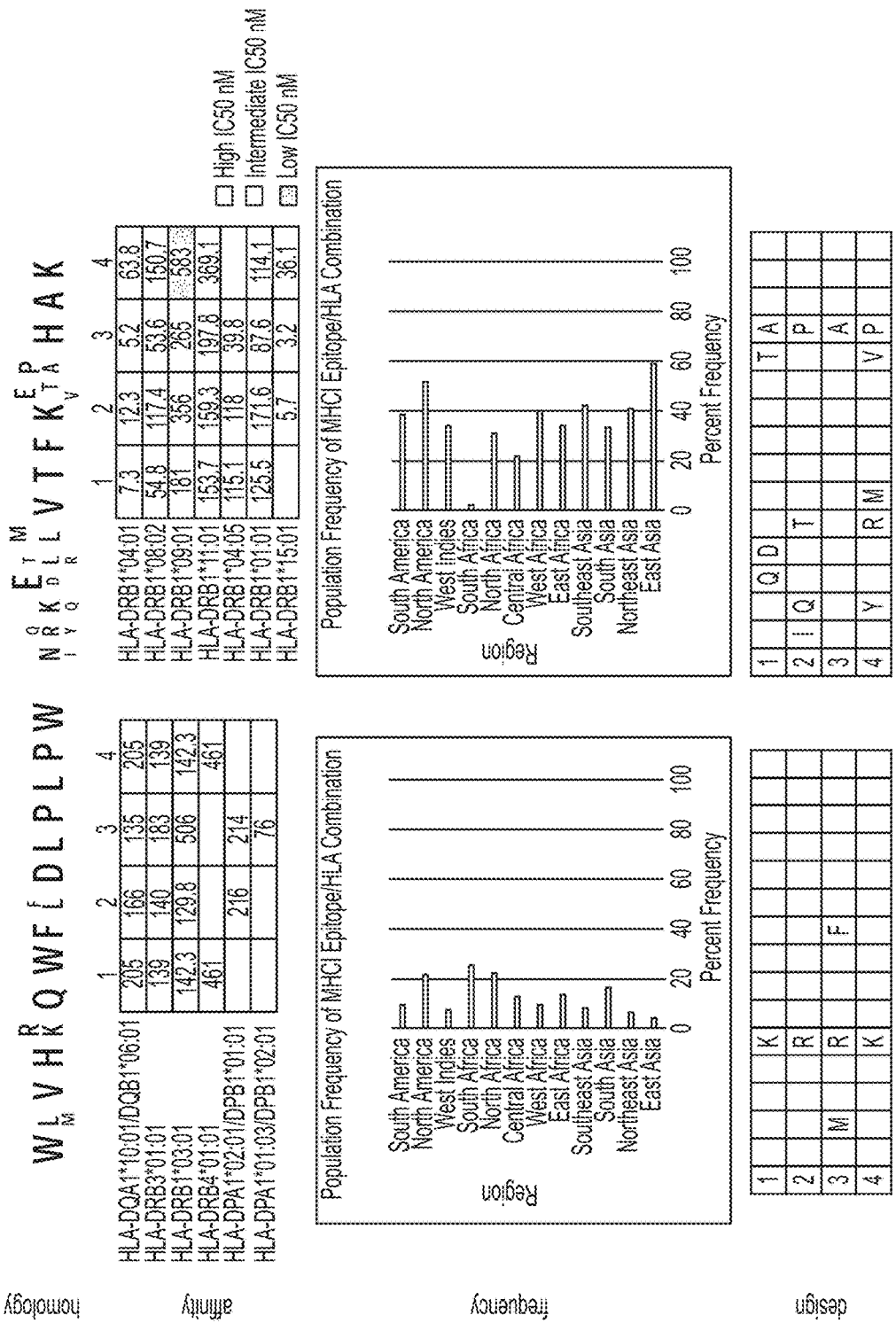
Figure 9C:
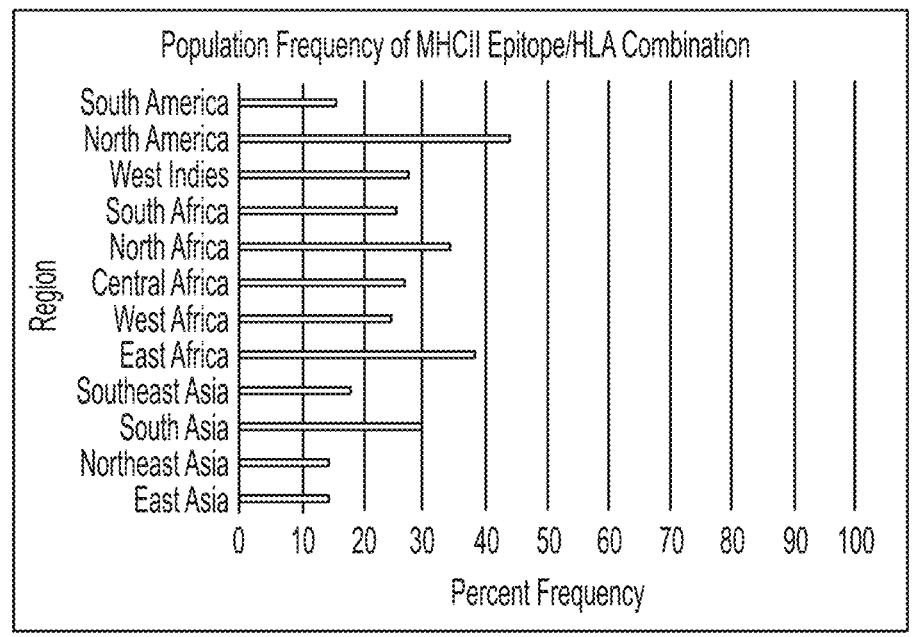

The instant study was designed to test the efficacy in AG129 mice of candidate ZIKV vaccines against a lethal challenge using a ZIKV vaccine comprising mRNA encoding ZIKV prME. Four groups of AG129 mice (n=8) were immunized intramuscularly (IM) with 10 μg (n=2) or 2 μg (n=2) of the candidate vaccine. One group of mice was administered PBS intramuscularly as a control. All mice were administered an initial dose of vaccine (Groups 1-4) or PBS (Group 5) on Day 0, and then the mice in Groups 1 and 3 were administered a boost dose on Day 21, while the mice in Group 5 were administered PBS on Day 21. All mice were challenged with a lethal dose of ZIKV in Day 42. All mice were then monitored for survival and weight loss. Anti-Zika neutralization IgG titer was determined on Day −1, Day 28 and Day 41, and viral load was determined 5 days post challenge. The 10 μg dose provided 100% protection, even with a single dose, and the 2 μg dose provided 60% protection with a single dose and 90% protection with prime-boost doses (see FIGS. 7A and 7B).

In experiments where a lipid nanoparticle (LNP) formulation is used, the formulation may include a cationic lipid, non-cationic lipid, PEG lipid and structural lipid in the ratios 50:10:1.5:38.5. The cationic lipid may be DLin-KC2-DMA or DLin-MC3-DMA (50 mol %), the non-cationic lipid may be DSPC (10 mol %), the PEG lipid is PEG-DOMG or PEG-DMG (1.5 mol %) and the structural lipid may be cholesterol (38.5 mol %), for example.

Example 25

Exemplary Dengue Sequences

An exemplary Dengue virus (DENV) peptide epitope may include two or more epitopes. The epitopes can be of the same sequence or different sequence and can be all T-cell epitopes, all B-cell epitopes or a combination of both. Furthermore, various end units for enhancing MHC processing of the peptides are possible.

The following sequences represent exemplary DENV peptide epitopes identified using a database screen (the sequences correspond to SEQ ID NO: 357-360):

```
DenV1    1      MRCVGIGNRDFVEGLSGATNVDVVLEHGSCVTTMAKDKPTLDIELLKTEVTNPAVLRKLCIEAKISNTTTDSRCPTQGEA      80

DenV2    1      MRCIGISNRDFVEGVSGGSNVDIVLEHGSCVTTMAKNKPTLDFELIKTEAKQPATLRKYCIEAKLTNTTTESRCPTQGEP      80

DenV3    1      MRCVGVGNRDFVEGLSGATWVDVVLEHGGCVTTMAKNKPTLDIELQKTEATQLATLRKLCIEGKITNITTDSRCPTQGEA      80

DenV4    1      MRCVGVGNRDFVEGVSGGAWVDLVLEHGGCVTTMAQGKPTLDFELTKTTAKEVALLRTYCIEASISNITTATRCPTQGEP      80

DenV1    81     TLVEEQDANFVCRRTFVCRGAGNGCCLFGKGSLLTCAKFKCVTKLEGKIVQYENLKYSVIVTVHTGDQHQVGNETTEHGT     160

DenV2    81     TLNEEQDKRFVCKHSMVDRGWGNGCGLFGKGGIVTCAMFTCKKNMEGKIVQPENLEYTVVITPHSGEEHAVGNDTGKHGK     160

DenV3    81     ILPEEQDQNYVCKHTYVDRGWGNGCGLFGKGSLVTCAKFQCLESIEGKIVQHENLKYTVIITVHTGDQHQVGNET--QGV     158

DenV4    81     YLKEEQDQQYICRRDVVDRGWGNGCGLFGKGGVVTCAKFSCSGKITGNLVQIENLEYTVVVTVHNGDTHAVGNDTSNHGV     160

DenV1    161    IATITPQAPTSEIQLTDYGALTLDCSPRTGLDFNFMVLLTMKEKSWLVHKQWFLDLPLPWTSGASTSQETWNRQDLLVTF     240

DenV2    161    EVKITPQSSITEAELTGYGTVTMECSPRTGLDFNFMVLLQMKDKAWLVHRQWFLDLPLPWLPGADTQGSNWIQKETLVTF     240

DenV3    159    TAAEITSQASTAEAILPEYGTLGLECSPRTGLDFNEMILLTMKDKWMVHRQWFFDLPLPWTSGATTKTPTWNRKELLVTF     238

DenV4    161    TAMITPRSPSVEVKLPDYGELTLDCEPRSGIDFNEMILMKMKKKTWLVHKQWFLDLPLPWTAGADTSEVHWNYKERMVTF     240
```

```
DenV1  241  KTAHAKKQEAVVLGSQEGAMHTALTGATIQTSSGTTTIFAGHLKCRLKMDKLTLKGISYVMCTGSFKLEKEVAETQHGTV  320

DenV2  241  KNPHAKKQDVVVLGSQEGAMHTALTGATEIQMSSGNLLFTGHLKCALRMDKLQLKGMSYSMCTGKFKVVKEIAETQHGTI  320

DenV3  239  KNAHAKKQEVVVLGSQEGAMHTALTGATEIQTSGGTSIFAGHLKCRLKMDKLKLKGMSYAMCLNTFVLKKEVSETQHGTI  318

DenV4  241  KVPHAKRQDVTVLGSQEGAMHSALAGATEVDSGDGNHMFAGHLKCKVRMEKLRIKGMSYTMCSGKFSIDKEMAETQHGTT  320

DenV1  321  LVQVKYEGTDAPCKIPFSSQDEKGVTQNGRLVTANPIVTDKEKPVNIEAEPPFGESYIVVGAGEKALKLSWFKKGSSIGK  400

DenV2  321  VIRVQYEGDGSPCKIPFEIMDLEKRHVLGRLITVNPIVTEKDSPVNIEAEPPFGDSYIIIGVEPDQLKLNWFKK------  394

DenV3  319  LIKVEYKGEDAPCKIPFSTEDGQGKAHNGRLITANPVVTKKEEPVNIEAEPPFGESNIVIGIGDKALKINWYRK------  392

DenV4  321  VVKVKYEGAGAPCKVPIEIRDVNKEKVVGRIISSTPLAENTNSVTNIELEPPFGDSYIVIGVGNSALTLHWFRKGSSIGK  400
```

Nucleic acid and amino acid sequences for each of DENV-1, DENV-2, DENV-3, and DENV-4 are shown in Tables 28 and 29, respectively.

Example 26

Dengue Virus RNA Vaccine Immunogenicity in Mice

This study provides a preliminary analysis of the immunogenicity of a nucleic acid mRNA vaccine using a Dengue virus (DENV) serotype 2 antigen in BALB/c mice. The study utilizes 44 groups of 10 BALB/c female (5) and male (5) mice (440 total, 6-8 weeks of age at study initiation, see Table 10 for design summary). In this study, construct numbers used are referenced and found in Table 28.

Mice were vaccinated on weeks 0 and 3 via intramuscular (IM) or intradermal (ID) routes. One group remained unvaccinated and one was administered $10^5$ plaque-forming units (PFU) live DENV2, D2Y98P isolate via intravenous (IV) injection as a positive control. Serum was collected from each mouse on weeks 1, 3, and 5; bleeds on weeks 1 and 3 were in-life samples (tail vein or submandibular bleeds) and week 5 will be a terminal (intracardiac) bleed. Individual serum samples were stored at −80° C. until analysis by neutralization or microneutralization assay. Pooled samples from each group at the week 5 time points were tested by Western blot for reactivity with viral lysate.

Signal was detected in groups 5, 15, 39, and 44 (live virus control) by a band that appeared between 50 and 60 kDa in the Western blot data. The data suggests that a mRNA vaccine to a single dengue viral antigen can produce antibody in preliminary studies.

In order to provide a Dengue vaccine having enhanced immunogenicity, RNA vaccines for concatemeric antigens were designed and tested according to the invention. These vaccines, which have significantly enhanced activity, in comparison to the single protein antigens described herein, are described below.

Example 27

In Silico Prediction of T Cell Epitopes for RNA Vaccine Design

Several peptide epitopes from Dengue virus were generated and tested for antigenic activity. The peptide epitopes are designed to maximize MHC presentation. In general the process of MHC class I presentation is quite inefficient, with only 1 peptide of 10,000 degraded molecules actually being presented. Additionally the priming of CD8 T cell with APCs having insufficient densities of surface peptide/MHC class I complexes results in weak responders exhibiting impaired cytokine secretion and a decrease memory pool. Thus, the process of designing highly effective peptide epitopes is important to the immunogenicity of the ultimate vaccine.

In silico prediction of desirable peptide epitopes was performed using Immune Epitope Database. Using this database several immunogenic Dengue T cell epitopes showing strong homology across all 4 Dengue serotypes were predicted. Examples of these epitopes are shown in FIGS. 8A-8C and 9A-9C.

Example 28

Prediction of DENV T Cell Epitopes for RNA Vaccine Design

The design of optimized vaccination systems to prevent or treat conditions that have failed to respond to more traditional treatments or early vaccination strategies relies on the identification of the antigens or epitopes that play a role in these conditions and which the immune system can effectively target. T cell epitopes (e.g., MHC peptide binding) for the various alleles shown in Table 32 were determined using Rapid Epitope Discovery System (ProImmune REVEAL & ProVE®—see Tables 33-40 for peptides). This system is used to identify those candidate epitopes that actually cause relevant immune responses from the numerous other potential candidates identified using algorithms to predict MHC-peptide binding. The REVEAL binding assay determines the ability of each candidate peptide to bind to one or more MHC I class alleles and stabilize the MHC-peptide complex. The assay identifies the most likely immunogenic peptides in a protein sequence by comparing the binding to that of a high affinity T cell epitope and detecting the presence or absence of the native conformation of the MHC-peptide complex. The epitope peptides are further tested using the assays described herein to confirm their immunogenic activity.

Example 29

Activity Testing for Predicted Peptide Epitopes

Exemplary peptide epitopes selected using the methods described above were further characterized. These peptide epitopes were confirmed to have activity using in vitro HLA binding assays (human lymphocyte binding assays). Peptides (9 aa peptides from the dengue antigen) were screened for their ability to bind to HLA. The analysis of the homology, affinity, frequency and design of these peptides is shown in FIGS. 8A-8C and 9A-9C.

Example 30

In Vivo Analysis of Mimectopes of Predicted Human Epitopes RNA Vaccines Methods IFNγ ELISpot. Mouse IFNγ ELISpot assays were performed using IFNγ coated Millipore IP Opaque plates according to the manufacturer's mouse IFNγ ELISPOT guidelines. Briefly, the plates were blocked using complete RPMI (R10) and incubated for 30 minutes prior to plating cells. Peptides (284-292, 408-419 or 540-548) were diluted to 5 different concentrations for stimulation at 5, -6, -7, -8, or -9 from an original stock concentration of 10 mM$^{(-2)}$. Mouse splenocytes (200,000-250,000 cells) were plated in appropriate wells with peptide, PMA+Ionomycin or R10 media alone. Cells were stimulated in a total volume of 125 μL per well. Plates were then incubated at 37° C., 5% $CO_2$ for 18-24 hrs. Plates were developed following the manufacturer's instructions. Plates were counted and quality controlled using the automated ELISPOT reader CTL ImmunoSpot/FluoroSpot.

Intracellular Cytokine Staining (ICS). Intracellular Cytokine Staining (ICS). For intracellular cytokine staining, individual splenocytes, were resuspended at a concentration of 1.5×10$^6$ cells per mL. Peptides (284-292, 408-419 or 540-548) were made into 5 dilutions from a stock concentration of 10 mM$^{(-2)}$. The final concentrations of each peptide were −5, −6, −7, −8, or −9 in their respective wells. Cells were stimulated in a final volume of 200 μL within a 96 well culture plate. After the addition of Golgi plug (0.2 μL per well), cells were incubated at 37° C., 5% $CO_2$ for 5 hours. Following stimulation, cells were surface stained, fixed, washed and put at 4° C. overnight. Intracellular staining was performed the following day, resulting in full panel of Live/Dead (Invitrogen), αCD3, αCD4, αCD8, αCD45, αCCR7, αCD44, αCD25, αIL-2, αIFNγ, and αTNFα (BD Biosciences). Cells were acquired in a 96-U bottom plate using BD LSR Fortessa HTS (BD Biosciences).

Results

The exemplary peptide epitopes selected using the methods described herein were used to produce tests mouse mimectopes of the predicted human epitopes. These mimectopes were analyzed for in vivo activity using restimulation assays during the acute phase of Dengue infection (Day 7). The methods were performed on dengue-infected IFNαβ/γ-receptor-deficient mice (AG129). Seven days post infection splenocytes were harvested and subjected to an ELISPOT assay to quantify secretion of cytokines by T cells (CD8) as described above. Briefly, the isolated splenocytes were stimulated with the test peptides and tested for T cell activation. If the peptide is an appropriate antigen, some cells would be present antigen during infection and would be capable of stimulating T cells. The methods for analyzing the T cell activation were performed as follows:

- T cells (at a known concentration) were incubated with a specific antigen in a cell culture well
- the activated T cells were transferred to ELISPOT plates (precoated with anti-cytokine antibody)
- the cells were incubated such that cytokines could be secreted
- the cells were washed off the plate and enzyme coupled secondary Ig was added
- the plates were washed and substrate was added
- positive spots were scored under microscope.

Figure 10:
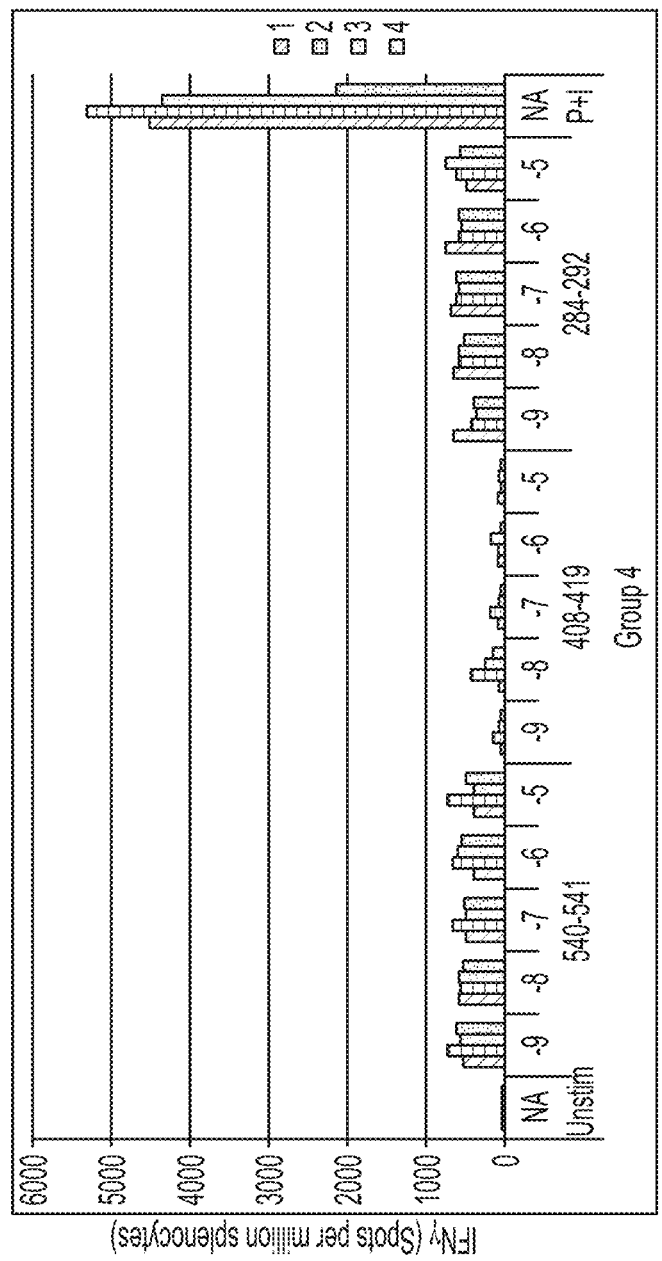
FIG. 10 is a graph depicting the results of an ELISPOT assay of dengue-specific peptides.
Figure 11:
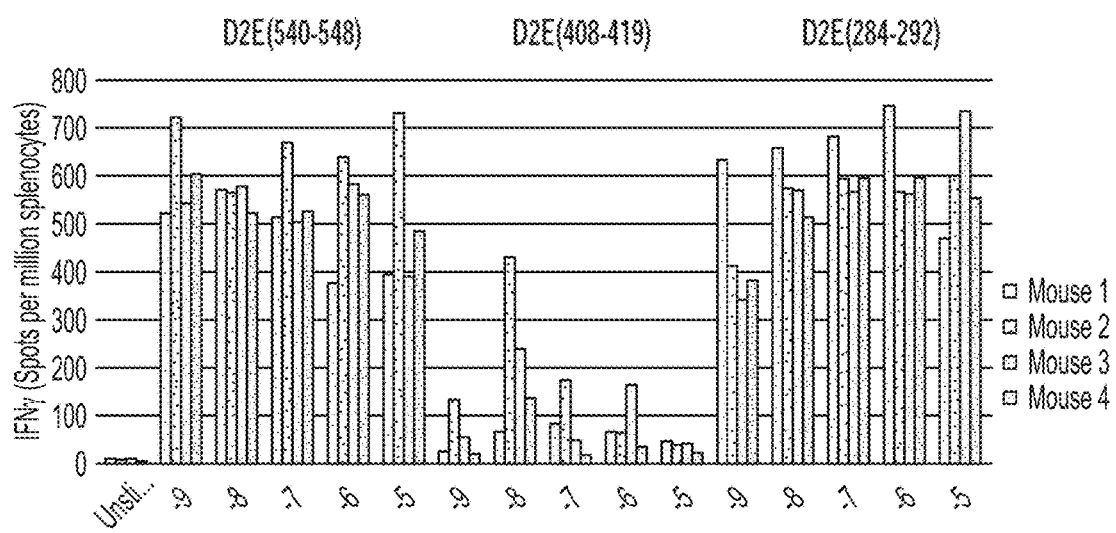
FIG. 11 is a graph depicting the results of an ELISPOT assay of dengue-specific peptides.

The data is shown in FIGS. 10 and 11. FIGS. 10 and 11 are graphs depicting the results of an ELISPOT assay of dengue-specific peptides measuring IFN-γ (spots per million splenocytes).

A schematic of an assay on a BLT Mouse Model (Bone Marrow/Liver/Thymus) is shown in FIG. 12. The results of a histogram analysis of human CD8 T cells stimulated with peptide epitope is also shown in FIG. 12.

The following two sequences were used as controls:

```
(V5)8-cathb:
                                    (SEQ ID NO: 361)
Kozak Start GKPIPNPLLGLDST-GFLG-GKPIPNPLLGLDST-

GFLG-GKPIPNPLLGLDST-GFLG-GKPIPNPLLGLDST-GFLG-

GKPIPNPLLGLDST-GFLG-GKPIPNPLLGLDST-GFLG-

GKPIPNPLLGLDST-GFLG-GKPIPNPLLGLDST Stop (v5)8-cathb + MHCi:
                                    (SEQ ID NO: 362)
Kozak Start GKPIPNPLLGLDST-GFLG-GKPIPNPLLGLDST-

GFLG-GKPIPNPLLGLDST-GFLG-GKPIPNPLLGLDST-GFLG-

GKPIPNPLLGLDST-GFLG-GKPIPNPLLGLDST-GFLG-

GKPIPNPLLGLDST-GFLG-GKPIPNPLLGLDST Stop
```

Some results are shown in Table 41.

Example 31

AG129 Mouse Challenge of Mimectopes of Predicted Human Epitopes from DENV2

A study is performed on AG129 mouse using a cocktail of 2 peptide epitopes. The immunogenicity of the peptide epitopes is determined in AG129 mice against challenge with a lethal dose of mouse-adapted DENV 2 strain D2Y98P. AG129 mice, which lack IFN α/β and γ receptor signaling, injected intradermally in the footpad with 10$^4$ PFU of DENV do not survive past day 5 post-injection. AG129 mice are vaccinated via intramuscular (IM) injection with either 2 μg or 10 μg of a cocktail of 2 peptide epitopes. The vaccines are given to AG129 mice with a prime and a boost (day 0 and day 28). The positive control group is vaccinated with heat-inactivated DENV 2. Phosphate-buffered saline (PBS) is used as a negative control. On day 56, mice are challenged with mouse-adapted DENV 2 and monitored for 10 days for weight loss, morbidity, and mortality. Mice that display severe illness, defined as >30% weight loss, a health score of 6 or above, extreme lethargy, and/or paralysis are euthanized.

Example 32

"Humanized" DENV Peptides Mouse Immunogenicity Study

A study analyzing immunogenicity of the peptide epitopes on humanized mice is performed. A single-dose cocktail (30 μg) containing 3 different peptide epitopes are delivered by IM route of immunization with prime and boost (day 0, day 28). A T cell (ELISPOT and ICS) characterization may be performed on Day 7, Day 28, and Day 56.

Example 33

Testing of Non-Human Primate (NHP) Mimectopes of Predicted DENV Human Epitopes

Non-human primate (NHP) mimectopes to the human epitopes may also be developed and tested for activity in NHP assays. The NHP mimectopes are designed based on the human antigen sequence. These mimectopes may be analyzed for in vivo activity in an NHP model using, for instance, restimulation assays. Once the NHPs have been infected, immune cells may be isolated and tested for sensitivity of activation by the particular mimectopes.

Example 34

Targeting of DENV Concatemeric Constructs Using Cytoplasmic Domain of MHC I

MHC-1_V5 concatemer constructs were developed and transfected in HeLa cells. Triple immunofluorescence using Mitotracker Red (mitochondria), anti-V5, and anti-MHC-1 antibodies plus DAPI was performed. MHC-1_V5 concatemer transfection in HeLa cells shows V5-MHC1 colocalization. MHC-1_V5 concatemer transfection also shows V5 has homogeneous cytoplasmic distribution and preferentially colocalizes with MHC1 and not with Mitotracker. These data demonstrate that the V5 concatemer with the cytoplasmic domain from MHC class I co-localizes with MHC class I expression, while the V5 concatemer without this sequence is only found in the cytoplasm following transfection in HeLa cells.

Example 35

In Vivo Analysis of DENV Concatemeric mRNA Epitope Construct

The Dengue concatemers used in this study consist of 8 repeats of the peptide TALGATEI (SEQ ID NO: 363), a mouse CD8 T cell epitope found in the DENV2 envelope. The peptide repeats were linked via cathepsin B cleavage sites and modified with the various sequences as follows:
(1) TALGATEI (SEQ ID NO: 363) peptide concatemer with no modification
(2) TALGATEI (SEQ ID NO: 363) peptide concatemer with IgKappa signal peptide
(3) TALGATEI (SEQ ID NO: 363) peptide concatemer with PEST sequence
(4) TALGATEI (SEQ ID NO: 363) peptide concatemer with IgKappa signal peptide and PEST sequence
(5) TALGATEI (SEQ ID NO: 363) peptide concatemer with MHC class I cytoplasmic domain
(6) TALGATEI (SEQ ID NO: 363) peptide concatemer with IgKappa signal peptide and MHC class I cytoplasmic domain
(7) Heat-inactivated DENV2 (D2Y98P)
(8) No immunization The immunogenicity of the peptide concatemeric candidate vaccines was determined in AG129 mice against challenge with a lethal dose of DENV strain D2Y98P. AG129 mice, which lack IFN α/β and γ receptor signaling, injected intradermally in the footpad with $10^4$ PFU of DENV do not survive past day 5 post-injection. (In this study, the mice died due to a problem with the heat-attenuation). The tested vaccines included constructs (1)-(8) disclosed above. AG129 mice were vaccinated via intramuscular (IM) injection with either 2 μg or 10 μg of the candidate vaccine. The vaccines were given to AG129 mice as a prime and a boost (second dose provided 28 days after the first dose). The positive control group was vaccinated with heat-inactivated DENV2. Phosphate-buffered saline (PBS) was used as a negative control.

On day 56, mice were challenged with mouse-adapted DENV2 and monitored for 10 days for weight loss, morbidity, and mortality. Mice that displayed severe illness, defined as >30% weight loss, a health score of 6 or above, extreme lethargy, and/or paralysis were euthanized. Notably, mice "vaccinated" with heat-inactivated DENV (positive control group) became morbid and died (they were not included in the challenge portion of the study).

In addition, individual serum samples were collected prior to challenge on day 54 and PBMCs were isolated and frozen for subsequent testing.

Figure 13A:
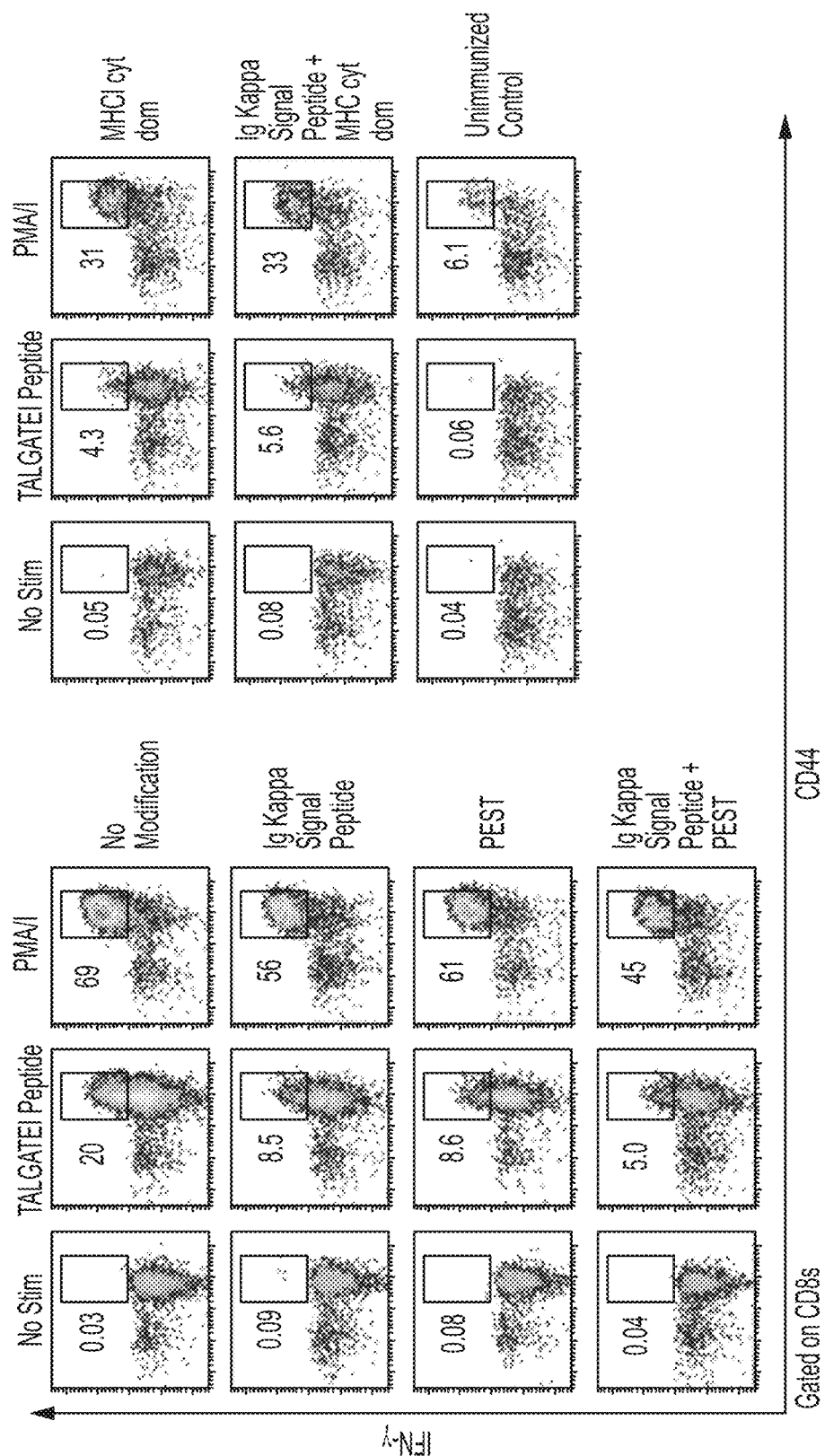
FIGS. 13A and 13B shows the results of an Intracellular Cytokine Staining assay performed in PBMC cells.
Figure 13B:
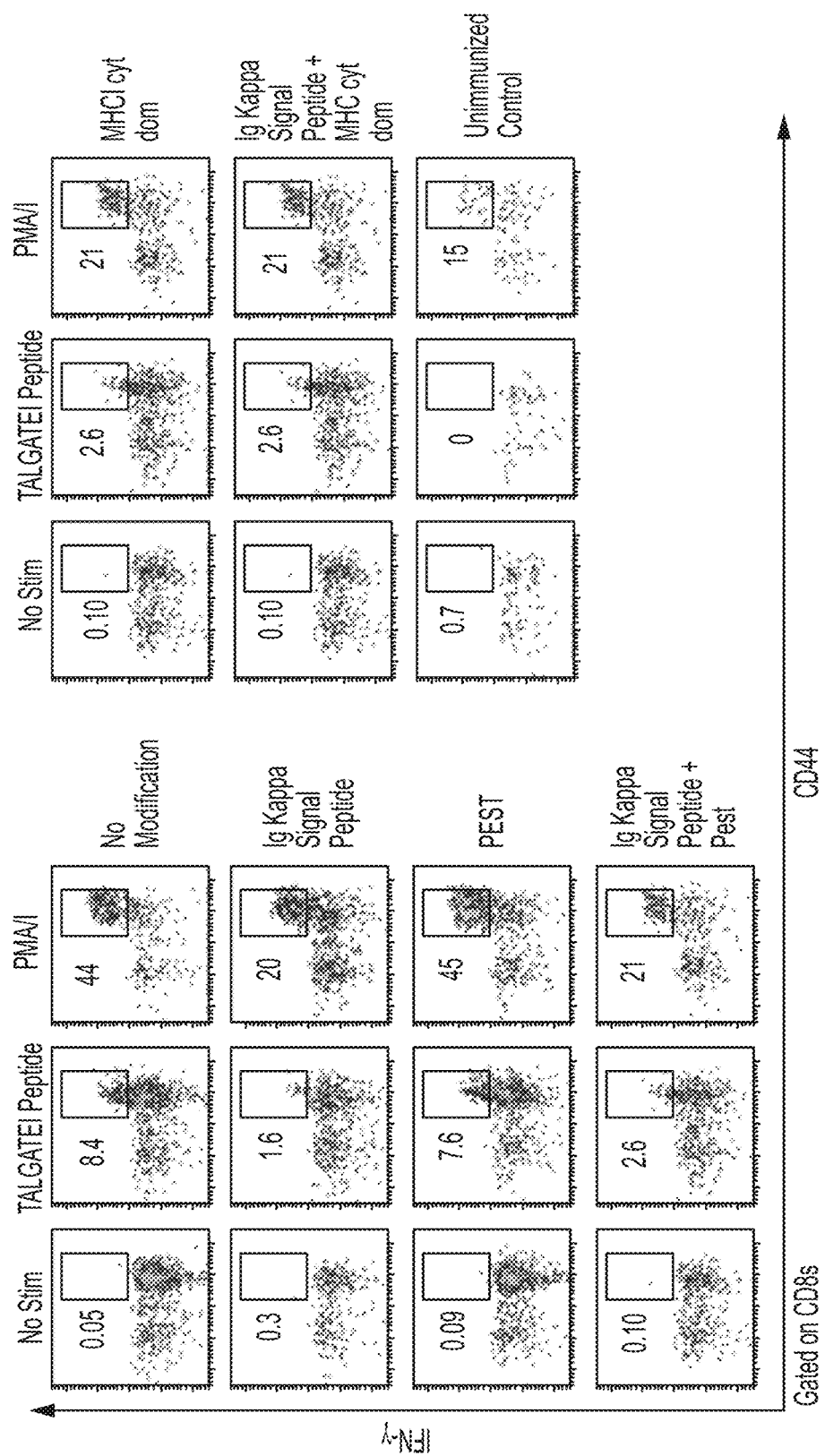

The AG129 mice PBMCs were thawed and stimulated with TALGATEI (SEQ ID NO: 363) peptide for 5 hours in a standard intracellular cytokine assay. For intracellular cytokine staining, PBMCs were thawed and suspended in media. The TALGATEI (SEQ ID NO: 363) peptide was administered to stimulate the cells. After the addition of Golgi plug, cells were incubated at 37° C., 5% $CO_2$ for 5 hours. Following stimulation, cells were surface stained, fixed, washed and put at 4° C. overnight. Intracellular staining was performed the following day and assayed via ELISPOT assay to quantify secretion of cytokines by T cells (CD8) as described above to determine T cell activation. If the peptide were an appropriate antigen, some cells would be present antigen during infection and would be capable of stimulating T cells. The results are shown in FIGS. 13A and 13B, which demonstrate that each of the peptides (1)-(6) stimulate T cell activation.

Example 36

Surface-Expressed DENV2 prME Antigens

Figure 14A:
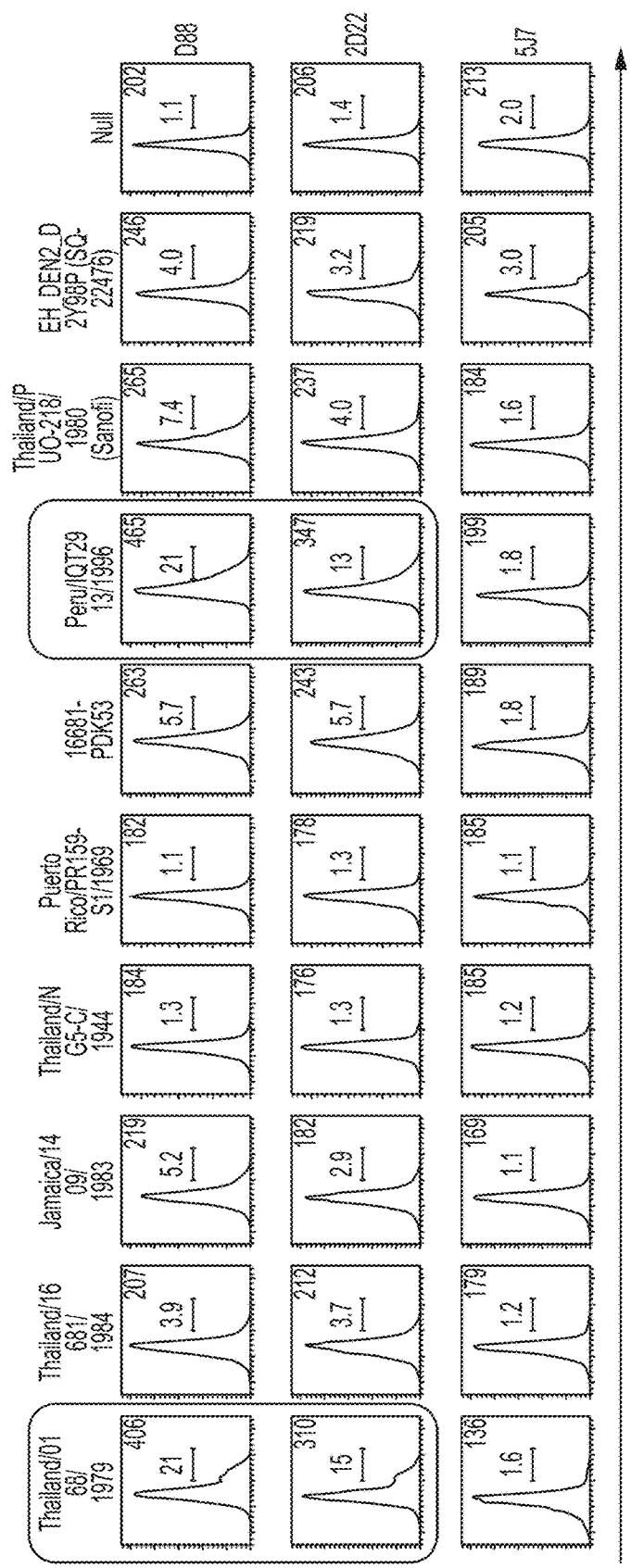
FIG. 14A shows FACS analyses of cells expressing DENV2 prMEs using different antibodies against Dengue envelope protein. Numbers in the upper right corner of each plot indicate mean fluorescent intensity.
Figure 14B:
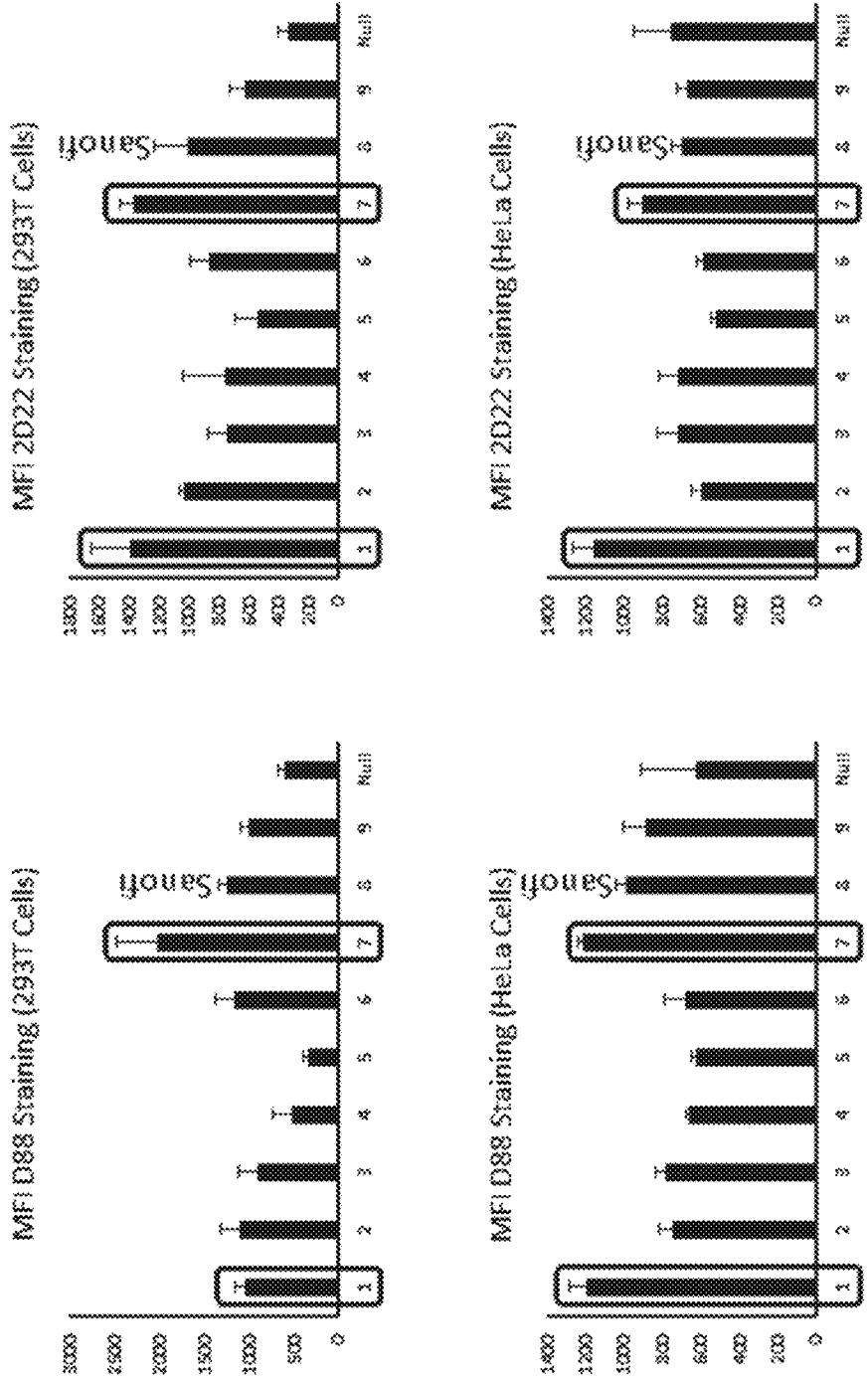
FIG. 14B shows a repeat of staining in triplicate and in two different cell lines (HeLa and 293T).

The DENV2 prME polypeptide antigen sequences provided in Tables 28 and 29 were tested to confirm that the DENV prME protein antigen is translated, properly folded and expressed on the surface of cells. For the polypeptide sequences, the bolded sequence is Dengue signal sequence, the underlined sequence is DENV2 precursor membrane sequence, and the unmarked sequence is DENV2 envelope sequence. The sequences encoding the polypeptides are codon-optimized. HeLa cells were transfected with DNA encoding the prMEs from nine different DENV2 isolates. After 24 hours, surface expression of the prME was detected using three different antibodies followed by goat-anti-human AF700 secondary antibody and subjecting the cells to FACS analyses. Each of the three antibodies is broadly neutralizing DENV2 prME antibodies that have in vivo efficacy against Dengue virus. D88 binds to DIII of Envelope protein for all 4 DENV serotypes (US20150225474). 2D22 binds to DIII of Envelope protein for DENV 2 serotype. 5J7 binds to 3 domains of Envelope protein for DENV 3 serotype. FIG. 14B shows that the D88 and 2D22 antibodies recognize two of the DENV2 prME antigens. These results show that the two DENV2 prME antigens identified as Thailand/01 68/1979 and Peru/IQT29 13/1996 are expressed at the cell surface in a conformationally correct form and are excellent vaccine candidates (FIG. 14A). FIG. 14B shows a repeat of staining in triplicate and in two different cell lines (HeLa and 293T). These results confirm proper conformation of expressed DENV2 prME antigens (in particular, the prME antigens from Thailand/01 68/1979 and Peru/IQT29 13/1996) and also evidence at least non-inferior and even superior DENV2 antigenicity as compared to Dengvaxia (CYD-TDV), a live attenuated tetravalent chimeric vaccine. Antigen expressed from the mRNA encoding DENV 2 prME from Peru/IQT2913/1996 shows the best binding to 2 different DENV2 antibodies in 293T cells and in HeLa cells (D88—binds all 4 serotypes 2D22—binds DENV 2). This construct has a single amino acid difference from the DENV 2 Envelope III Domain immunodeterminant region (see bold, underline in SEQ ID NO: 273, DENV 2 prME (Peru/IQT2913/1996) in Table 29).

Example 37

OVA Multitope In Vitro Screening Assay Kinetic Analysis

Figure 15:
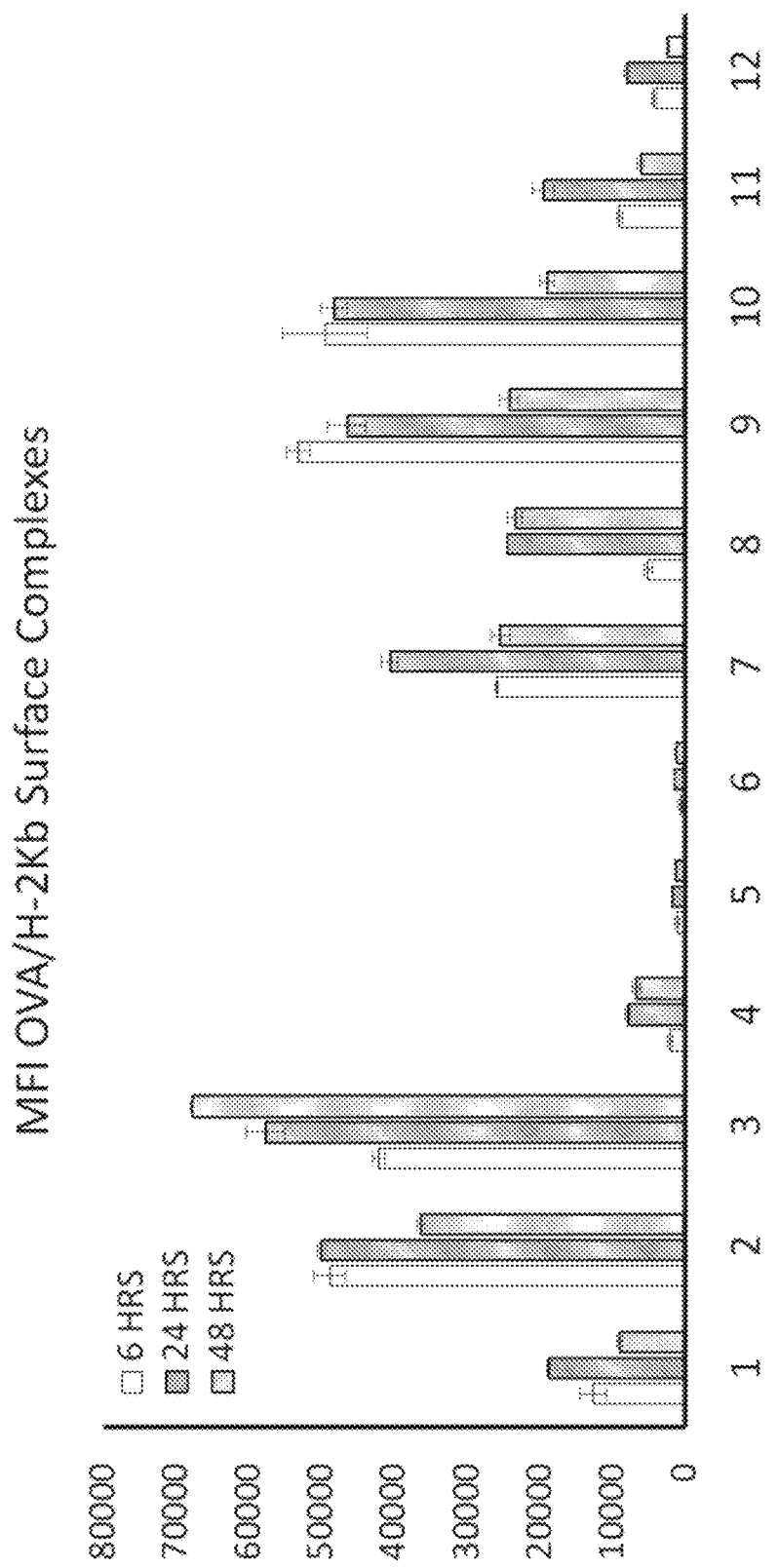
FIG. 15 is a graph showing the kinetics of OVA peptide presentation in Jawsii cells. All mRNAs tested are formulated in MC3 lipid nanoparticles.

Antigen surface presentation is an inefficient process in the antigen presenting cells (APC). Peptides generated from proteasome degradation of the antigens are presented with low efficiency (only 1 peptide of 10000 degraded molecules is actually presented). Thus, priming of CD8 T cells with APCs provides insufficient densities of surface peptide/MHC I complexes, resulting in weak responders exhibiting impaired cytokine secretion and decreased memory pool. To improve DENV mRNA vaccines encoding concatemeric DENV antigens, an in vitro assay was designed to test the linkers used to connect peptide repeats, the number of peptide repeats, and sequences known to enhance antigen presentation.

mRNA constructs encoding one or more OVA epitopes were configured with different linker sequences, protease cleavage sites, and antigen presentation enhancer sequences. Their respective sequences were as shown in Table 43. To perform the assay, 200 ng of each MC3-formulated mRNA construct was transfected into JAWSII cells in a 24-well plate. Cells were isolated at 6, 24, and 48 hours post transfection and stained with fluorescently-labeled Anti-Mouse OVA257-264 (SIINFEKL (SEQ ID NO: 364)) peptide bound to H-2Kb. Staining was analyzed on a LSR-Fortessa flow cytometer. Samples were run in triplicate. The Mean Fluorescent Intensity (MFI) for each mRNA construct was measured and shown in FIG. 15. Constructs 2, 3, 7, 9, and 10 showed enhanced surface presentation of the OVA epitope, indicating that the configurations of these constructs may be used for DENV mRNA vaccine. Construct 5 comprises a single OVA peptide and a KDEL sequence that is known to prevent the secretion of a protein. Construct 5 showed little surface antigen presentation because the secretion of the peptide was inhibited.

Example 38

Antibody Binding to DENV-1, 2, 3, and 4 prME Epitopes

DENV mRNA vaccines encoding concatemeric antigen epitopes were tested for binding to antibodies known to recognize one or more DENV serotypes. To test antibody binding to the epitopes, 200 ng of DENV mRNA vaccines encoding different Dengue prME epitopes were transfected into HeLa cells in 24-well plates using the TransitIT-mRNA Transfection Kit (Mires Bio). The DENV mRNA vaccine constructs are shown in Table 28. Transfections were done in triplicate. After 24 hours, surface expression was detected using four different antibodies (10 µg/mL) followed by either goat-anti-human or anti-mouse AF700 secondary antibody (1/500). Signal generated from antibody binding are shown as Mean Fluorescent Intensity (MFI) (FIG. 16). Antibody D88 is known to recognize all 4 serotypes and bound to all antigen epitopes encoded by the DENV mRNA vaccine constructs tested. Antibody 2D22 is known to recognize only DENV 2 and preferentially bound to construct 21, which encodes DENV 2 antigen epitopes. Antibody 2D22 also showed weak binding to epitopes of other DENV serotypes. Antibody 5J7 is known to recognize only DENV 3 and only bound to antigen epitopes encoded by constructs 13, 19, and 20, which encode DENV 3 antigen epitopes. Antibody 1-11 is known to bind strongly to DENV 1 and 2, to bind weakly to DENV 3 and to bind little DENV 4. Antibody 1-11 bound to DENV 1, 2, and 3, and binding to DENV 3 antigen epitopes was stronger than binding to DENV 1 or 2 (FIG. 16).

Example 39

DENV prME Challenge Study in Cynomolgus (Cyno) Monkey Model

Shown in Table 45 is the design of DENV prME challenge study in cynomolgus (cyno) money. Indicated DENV mRNA vaccine encoding prME antigen epitopes, or vaccines thereof, are used to immunize cyno. The vaccines are formulated in lipid nanoparticles (e.g., MC3 formulation) and administered to the cyno monkeys intramuscularly on day 0, 21, and 42. Dosages of the vaccines are 250 µg or 5 µg per immunization. In experiments where a combination of different DENV mRNA vaccines are used, 250 µg or 5 µg of each mRNA vaccine is used. FLAG-tagged H10N8 flu vaccine is used as control at a dosage of 250 µg per immunization. Naïve cyno monkeys without immunization are also used as control. Cyno monkey sera are collected on days 20, 41, 62, and 92 post initial immunization and used for serotype-specific neutralization assays.

Immunized cyno monkeys are challenged on day 63 post initial immunization with indicated DENV viruses. Cyno monkey sera are collected on days 62 (pre-challenge), 63-66, 68, 70, 72, 76, and 92 (end of life) to determine serum viral load.

Example 40

Dengue 2 prME Challenge Study in AG129 Mice

Figure 17A:
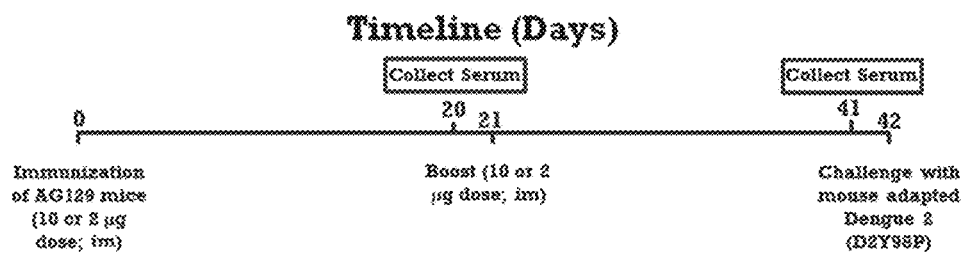
FIGS. 17A-17D are graphs showing the design and the results of a challenge study in AG129 mice.
Figure 17B:
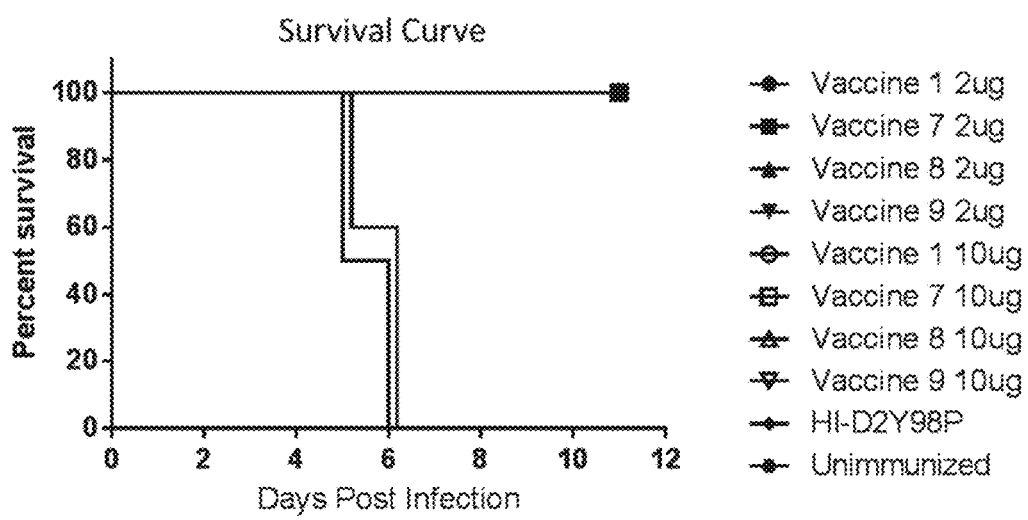

The instant study was designed to evaluate the efficacy of four DENV mRNA vaccine constructs (constructs 21-24 in Table 44) in AG129 mice challenge assays. The schedule of the challenge study is shown in FIG. 17A. The DENV mRNA vaccines were formulated in lipid nanoparticles (e.g., MC3 formulation) and administered to the AG129 mice intramuscularly on days 0 and 21. Dosages of the vaccines were 2 µg or 10 µg per immunization. Heat inactivated D2Y98P strain was used as a negative control to vaccinate the mice. Naïve AG129 mice without immunization were also used as control.

Figure 17C:
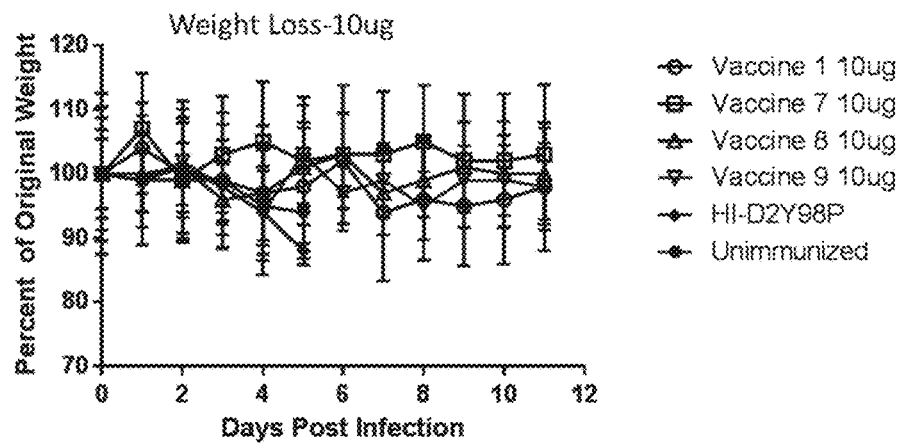
Figure 17D:
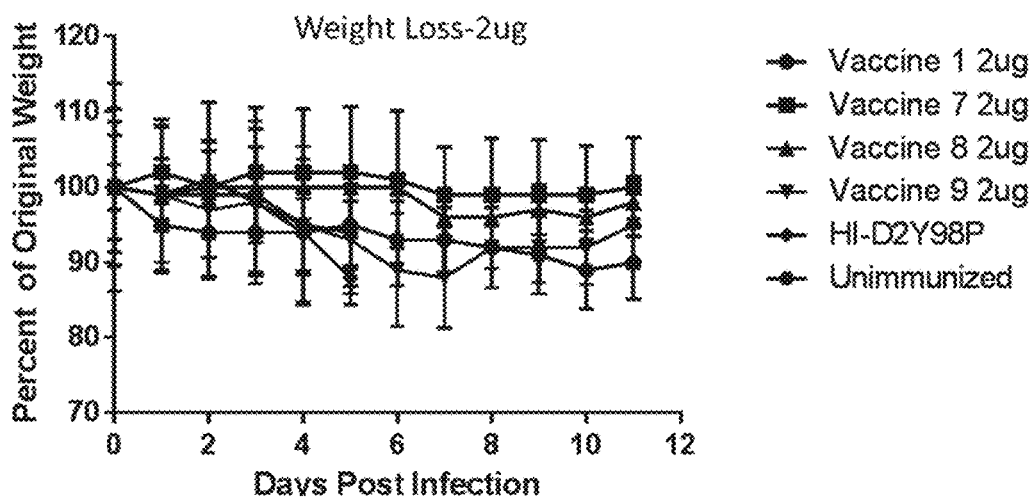

Immunized AG129 mice were challenged on day 42 post initial immunization with Dengue D2Y98P virus (s.c., 1e5 PFU per mouse). AG129 mice sera were collected on days 20 and 41 post initial immunization and used for serotype-specific neutralization assays. Mice immunized with any of the four DENV mRNA vaccine constructs survived, while the control mice died. These data demonstrate that, after lethal challenge, there was 100% protection provided by each mRNA vaccine construct, regardless of dose. The weights and health of the mice were monitored and the results were plotted in FIGS. 17C-17D.

Figure 18:
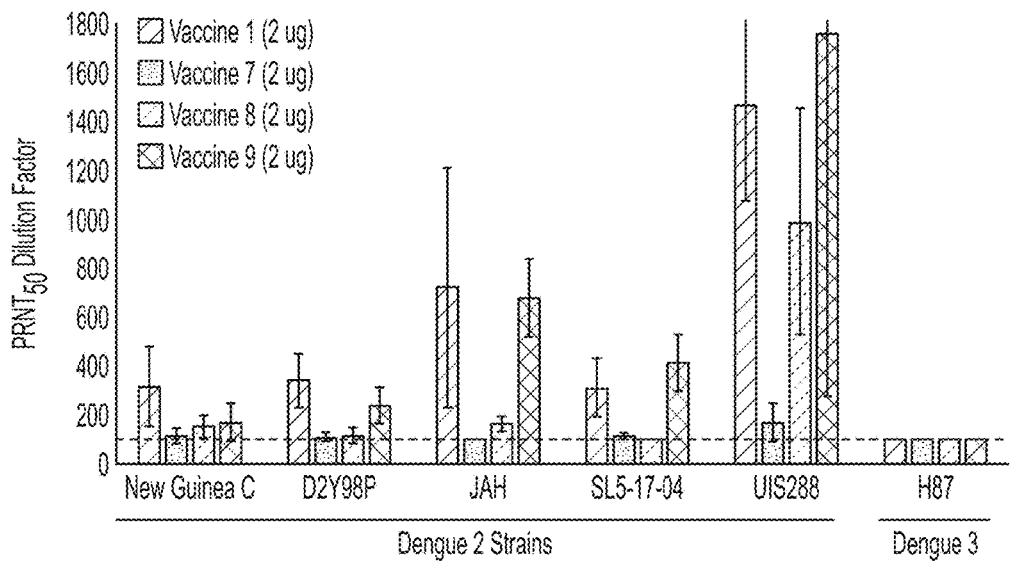
FIG. 18 is a graph showing the results of an in vitro neutralization assay using serum from mice immunized with the DENV mRNA vaccines in FIGS. 17A-17D.
Figure 19A:
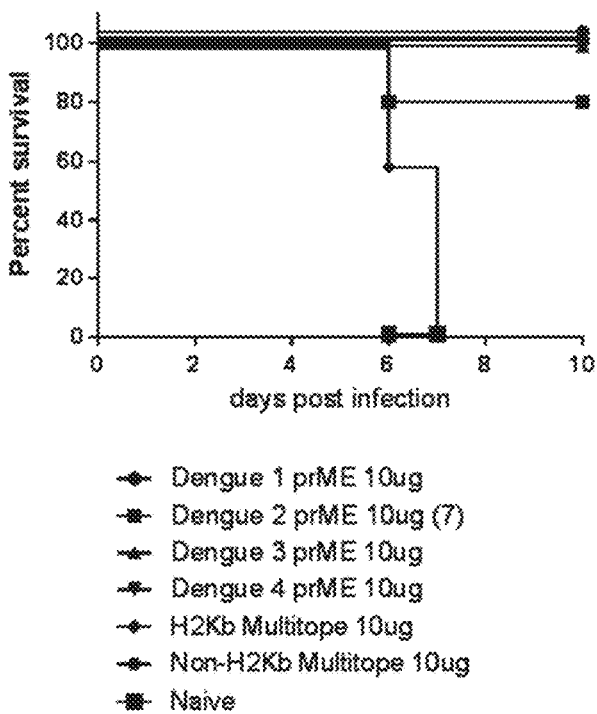
Figure 19B:
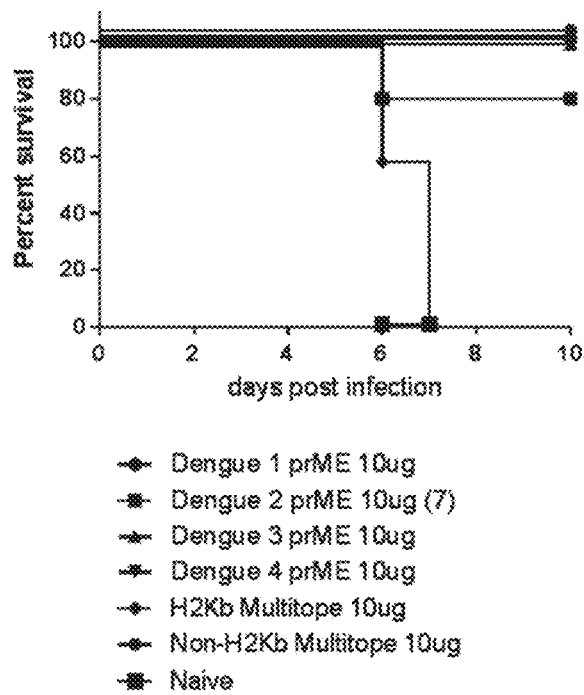
Figure 19C:
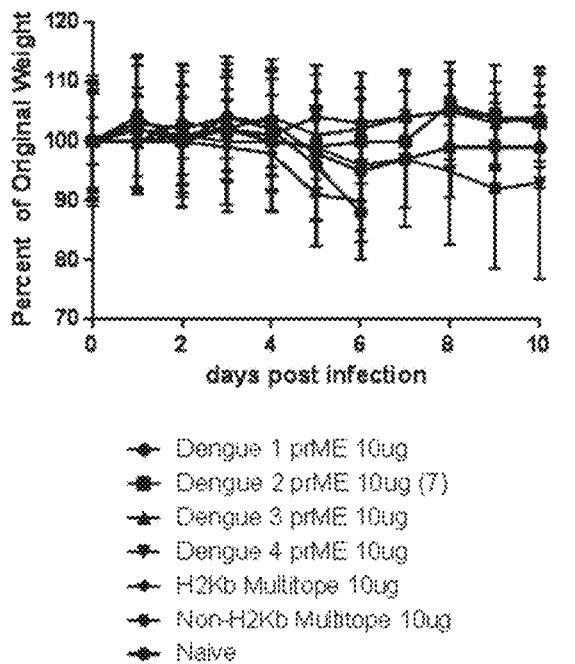
Figure 19D:
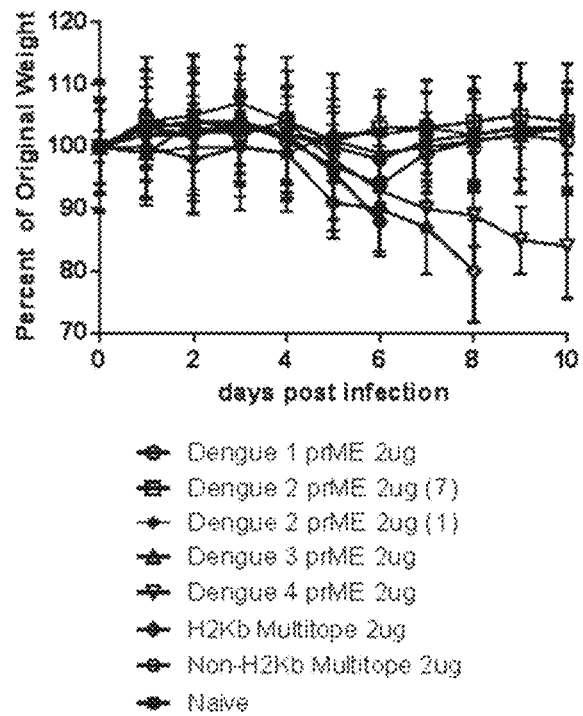
Figure 19E:
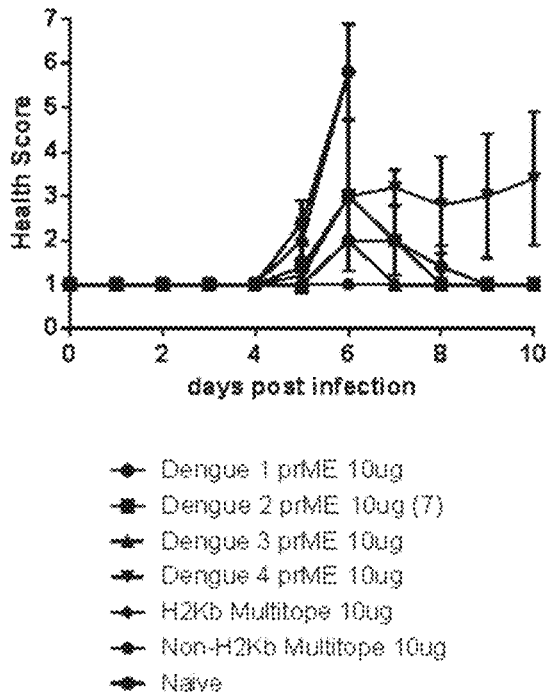
Figure 19F:
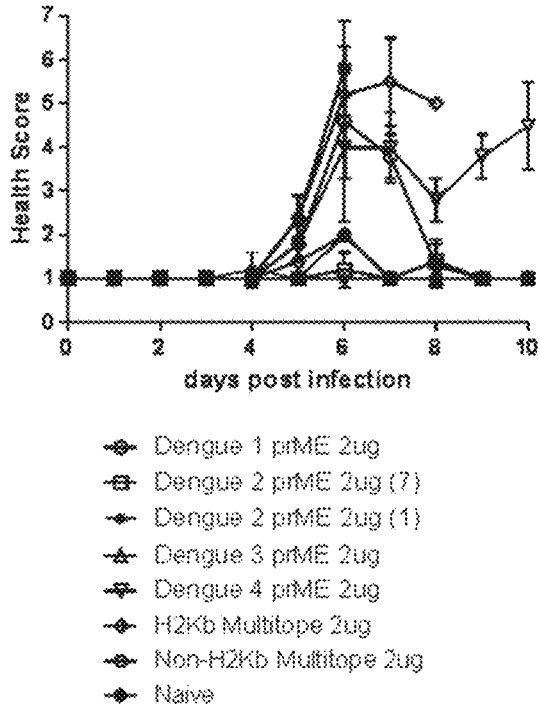
Figure 19G:
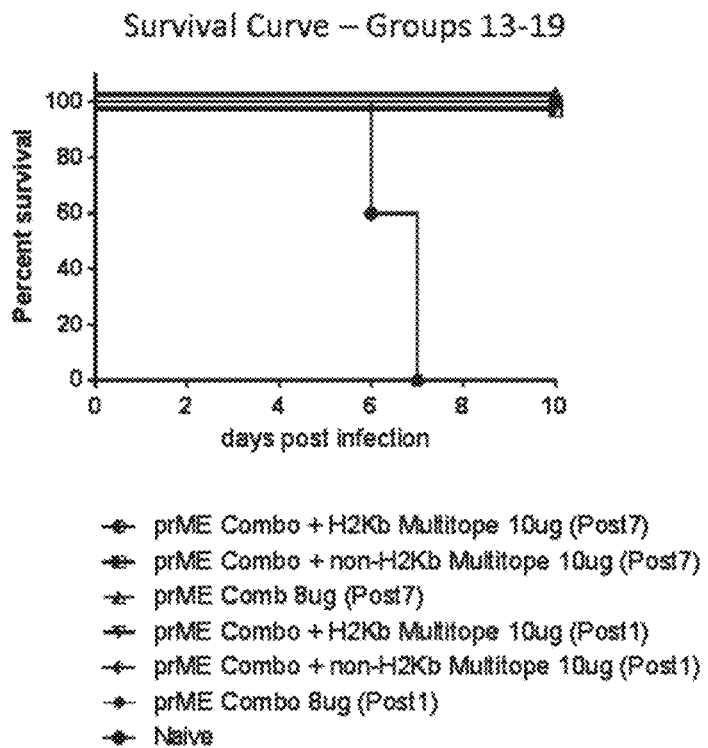
Figure 19H:
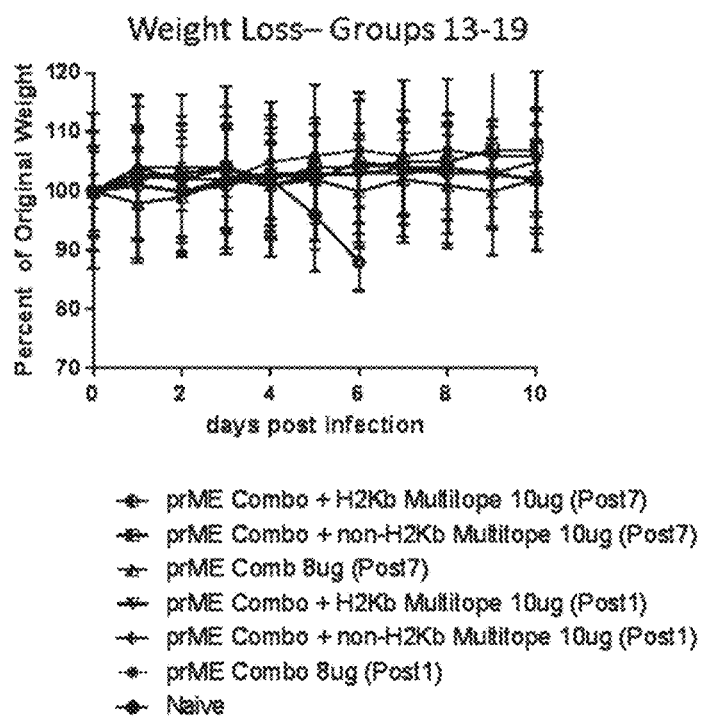
Figure 21A:
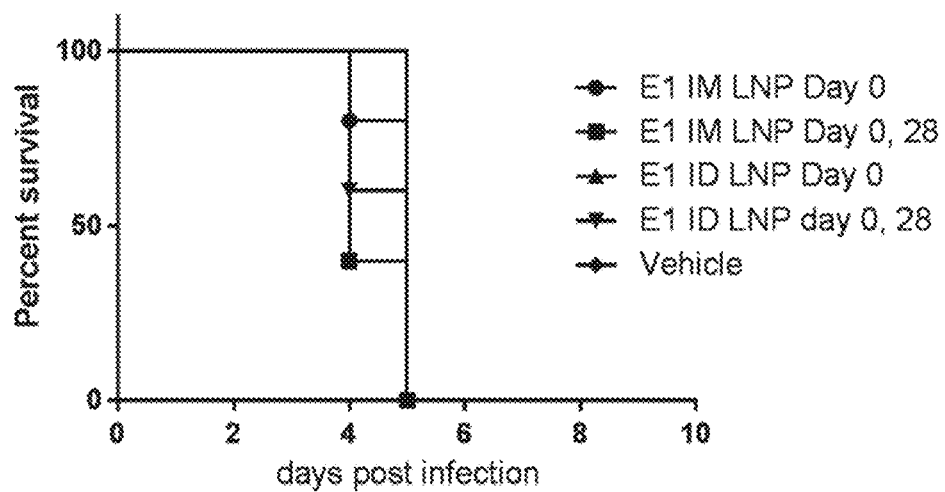
FIG. 21A is a graph showing the survival rates of AG129 mice vaccinated with a single 2 μg dose or two 2 μg doses of Chikungunya E1 antigen administered either intramuscularly or intradermally.
Figure 21B:
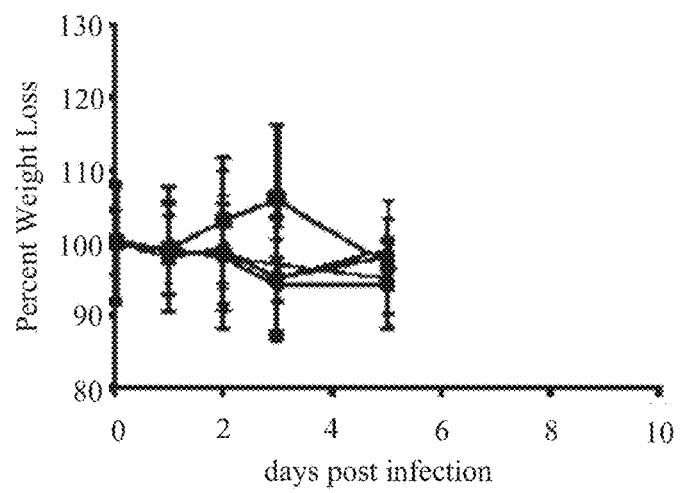
FIG. 21B is a graph showing the percent weight loss of AG129 mice vaccinated with a single 2 μg dose or two 2 μg doses of Chikungunya E1 antigen administered either intramuscularly or intradermally.
Figure 21C:
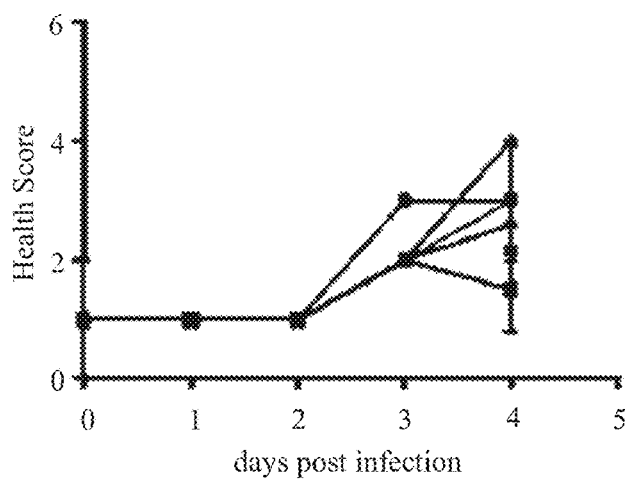
FIG. 21C is a graph showing the health scores of AG129 mice vaccinated with a single 2 μg dose or two 2 μg doses of Chikungunya E1 antigen administered either intramuscularly or intradermally.

Mice sera collected from mice immunized with 2 µg of the DENV mRNA vaccines were able to neutralize several DENV 2 strains and variations in the neutralization ability between the tested mRNA vaccines and between different DENV 2 strains were observed (FIG. 18).

Example 41

DENV prME Challenge Study in AG129 Mouse Model

Shown in Table 46 is the design of a DENV prME challenge study in AG129 mice, including the mRNA constructs tested, the vaccination schedule, the dosage, the challenge strains, and the serum collection schedule.

Indicated DENV mRNA vaccines encoding prME antigen epitopes, or vaccines thereof, were used to immunize AG129 mice. The vaccines were formulated in lipid nanoparticles (e.g., MC3 formulation) and administered to the mice intramuscularly on days 0 and 21. Dosages of the vaccines were 2 µg or 10 µg per immunization. In experiments where a combination of different DENV mRNA vaccines was used, 2 µg of each mRNA vaccine was used. Naïve AG129 mice without immunization were used as control. AG129 mice sera were collected on days 20 and 41 post initial immunization and used for serotype-specific neutralization assays.

Immunized AG129 mice were challenged on day 42 post initial immunization with Dengue D2Y98P virus (s.c., 1e5 PFU per mouse). The weights and health of the mice were monitored for 14 days post infection and the results were plotted in FIGS. 19A-19I.

Example 42

Virus-Like Particles

The antigens produced from the DENV prME mRNA vaccines of the present disclosure, when expressed, are able to assemble into virus-like particles (VLPs). The instant study was designed to evaluate the immunogenicity of the VLPs by negative stain electron microscope imaging. DENV mRNA vaccine constructs 21-24 were expressed and VLPs were assembled an isolated. The VLPs were visualized under negative stain electron microscopy. Construct 23 is the vaccine construct used by Sanofi in its DENV vaccines. Constructs 21, 22, and 24 produced more uniform VLPs, suggesting that these VLPs may be more superior in their immunogenicity than the VLPs produced from construct 23.

Example 43

Exemplary Nucleic Acids Encoding CHIKV RNA Polynucleotides for Use in a RNA Vaccine Exemplary sequences that can be used to encode CHIKV E1, E2, E1-E2, and C-E3-E2-6K-E1 RNA polynucleotides for use in the CHIKV RNA vaccine are given in Table 47.

Example 44

Protocol to Determine Efficacy of mRNA-Encoded Chikungunya Antigen Candidates Against CHIKV Chikungunya virus (CHIKV) has a polycistronic genome and different antigens, based on the Chikungunya structural protein, are possible. There are membrane-bound and secreted forms of E1 and E2, as well as the full length polyprotein antigen, which retains the protein's native conformation. Additionally, the different CHIKV genotypes can also yield different antigens.

The efficacy of CHIKV candidate vaccines in AG129 mice against challenge with a lethal dose of CHIKV strain 181/25 was investigated. A129 mice, which lack IFN α/β receptor signaling, injected intradermally in the footpad with $10^4$ PFU of CHIKV 181/25 virus have a 100% survival rate post-injection. In contrast, AG129 mice, which lack IFN α/β and γ receptor signaling, injected intradermally in the footpad with $10^4$ PFU of CHIKV 181/25 virus do not survive past day 5 post-injection. The tested vaccines included: MC3-LNP formulated mRNA encoded CHIKV-E1, MC3-LNP formulated mRNA encoded CHIKV-E2, and MC3-LNP formulated mRNA encoded CHIKV-E1/E2/E3/C. Fifteen groups of five AG129 mice were vaccinated via intradermal (ID) or intramuscular (IM) injection with either 2 μg or 10 μg of the candidate vaccine. The vaccines were given to AG129 mice as single or two doses (second dose provided 28 days after the first dose). The positive control group was vaccinated via intranasal instillation (20 μL volume) with heat-inactivated CHIKV. Phosphate-buffered saline (PBS) was used as a negative control.

On day 56, mice were challenged with $1\times10^4$ PFU of CHIKV via ID injection in a 50 μL volume and monitored for 10 days for weight loss, morbidity, and mortality. Mice that displayed severe illness, defined as >30% weight loss, a health score of 6 or above, extreme lethargy, and/or paralysis were euthanized. Notably, mice "vaccinated" with heat-inactivated CHIKV (positive control group) became morbid and were euthanized following the second dose of HI-CHIKV (they were not included in the challenge portion of the study).

In addition, individual samples were tested for reactivity in a semi-quantitative ELISA for mouse IgG against either Chikungunya-specific E1 (groups 1-4), Chikungunya-specific E2 (groups 5-8), or Chikungunya-specific E1 and E2 proteins (groups 9-15).

The health status is scored as indicated in Table 51.

Example 45

Efficacy of Chikungunya E1 Antigen mRNA Vaccine Candidate

AG129 mice (n=5 per group) were vaccinated with 2 μg or 10 μg of MC-3-LNP formulated mRNA encoding CHIKV E1. The AG129 mice were vaccinated on either Day 0 or Days 0 and 28 via IM or ID delivery. On Day 56 following final vaccination all mice were challenged with a lethal dose of CHIKV. The survival curve, percent weight loss, and health status of the mice vaccinated with 2 μg CHIKV E1 mRNA are shown in FIGS. 21A-21C. The survival results are tabulated in Table 52. The survival curve, percent weight loss, and health status of the mice vaccinated with 10 μg CHIKV E1 mRNA are shown in FIGS. 24A-24C. The survival results are tabulated in Table 53.

As shown in Table 52, the 2 μg dose of CHIKV E1 mRNA vaccine gave no protection post-CHIKV infection challenge when administered via IM or ID with either a single dose or two doses. Likewise, the single dose of 10 μg CHIKV E1 vaccine provided little to no protection when administered via IM or ID. However, as indicated in Table 53, the 10 μg dose of CHIKV E1 mRNA vaccine provided 60% protection post-CHIKV challenge when administered via IM using two doses and provided 80% protection post-CHIKV challenge when administered via ID using two doses.

In all experiments, the negative control mice had a ~0% survival rate, as did the positive control mice (heat-inactivated CHIKV), which died before CHIKV challenge. Some mice died during the vaccination period.

Example 46

Efficacy of Chikungunya E2 Antigen mRNA Vaccine Candidate

Figure 22A:
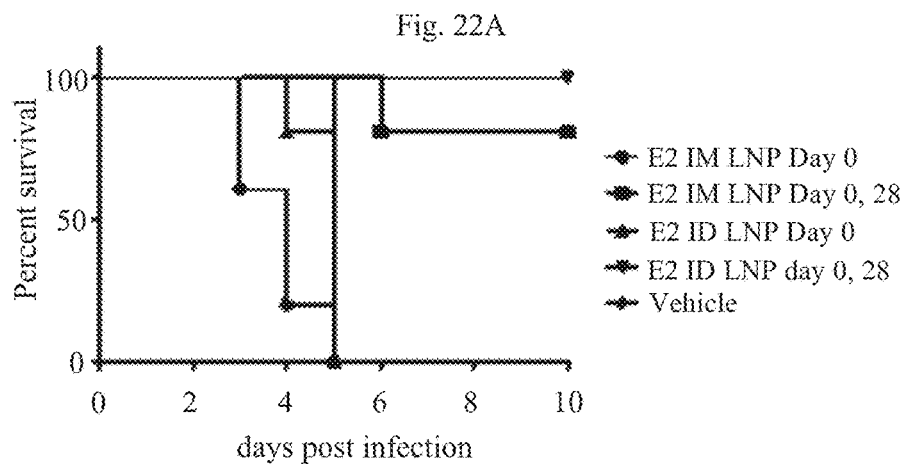
FIG. 22A is a graph showing the survival rates of AG129 mice vaccinated with a single 2 μg dose or two 2 μg doses of Chikungunya E2 antigen administered either intramuscularly or intradermally.
Figure 22B:
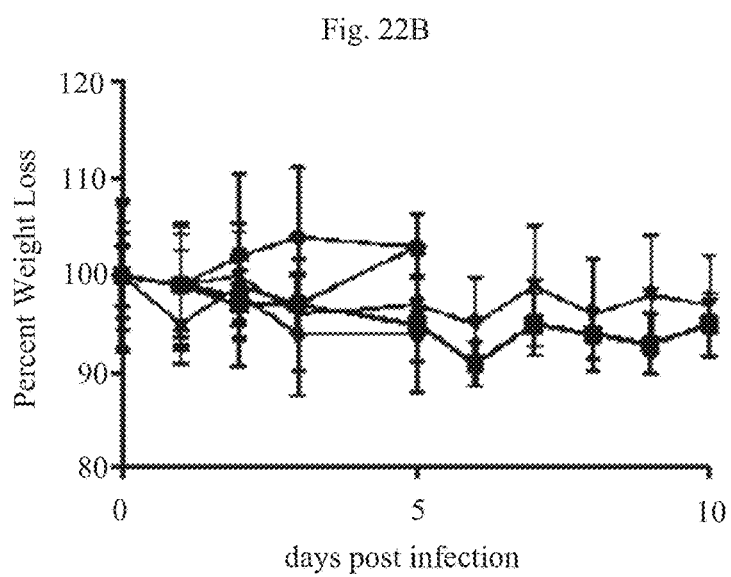
FIG. 22B is a graph showing the percent weight loss of AG129 mice vaccinated with a single 2 μg dose or two 2 μg doses of Chikungunya E2 antigen administered either intramuscularly or intradermally.
Figure 22C:
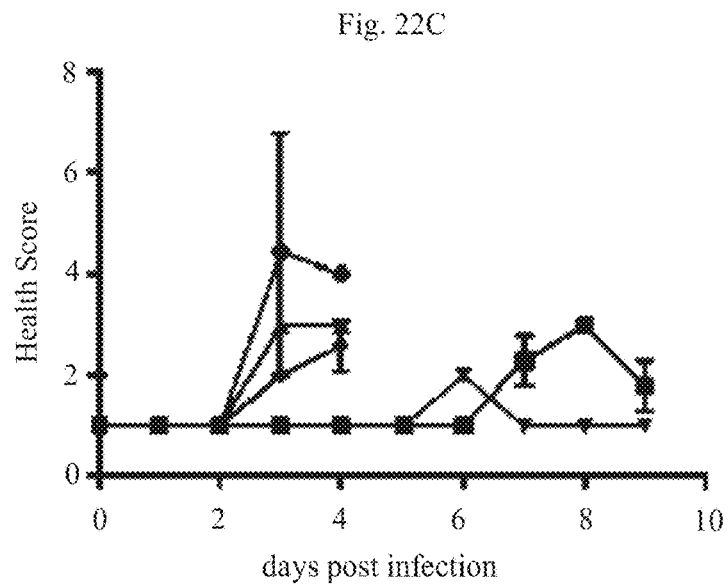
FIG. 22C is a graph showing the health scores of AG129 mice vaccinated with a single 2 μg dose or two 2 μg doses of Chikungunya E2 antigen administered either intramuscularly or intradermally.
Figure 25A:
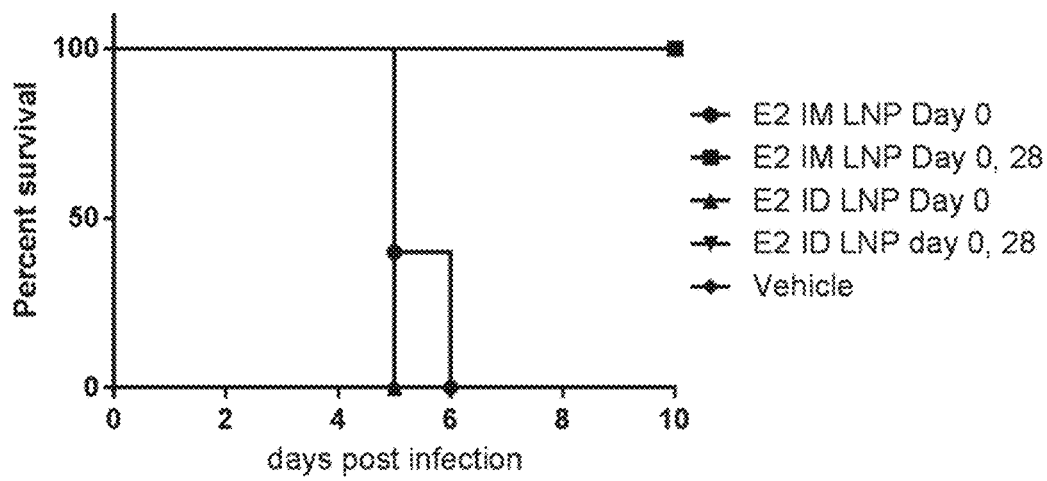
FIG. 25A is a graph showing the survival rates of AG129 mice vaccinated with a single 10 μg dose or two 10 μg doses of Chikungunya E2 antigen administered either intramuscularly or intradermally.
Figure 25B:
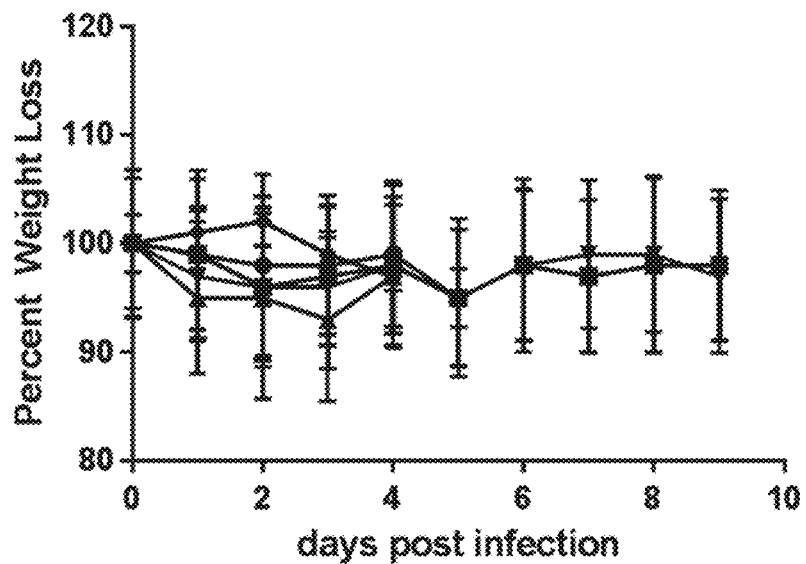
FIG. 25B is a graph showing the percent weight loss of AG129 mice vaccinated with a single 10 μg dose or two 10 μg doses of Chikungunya E2 antigen administered either intramuscularly or intradermally.
Figure 25C:
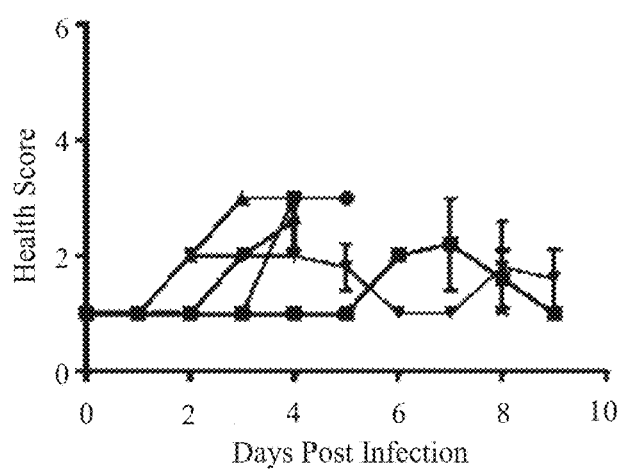
FIG. 25C is a graph showing the health scores of AG129 mice vaccinated with a single 10 μg dose or two 10 μg doses of Chikungunya E2 antigen administered either intramuscularly or intradermally.

AG129 mice (n=5 per group) were vaccinated with 2 μg or 10 μg of MC-3-LNP formulated mRNA encoding CHIKV E2. The mice were vaccinated on either Day 0 or Days 0 and 28 via IM or ID delivery. On Day 56 following final vaccination all mice were challenged with a lethal dose of CHIKV. The survival curve, percent weight loss, and health status of the mice vaccinated with 2 μg CHIKV E2 mRNA are shown in FIGS. 22A-22C. The survival results are tabulated in Table 54 below. The survival curve, percent weight loss, and health status of the mice vaccinated with 10 μg CHIKV E2 mRNA are shown in FIGS. 25A-25C. The survival results are tabulated in Table 55.

As shown in Table 54, the 2 μg dose of CHIKV E2 mRNA vaccine gave no protection post-CHIKV infection challenge when administered via IM or ID in a single dose. However, when provided in two doses, the 2 μg dose of CHIKV E2 mRNA vaccine provided 80% protection when administered via IM and 100% protection when administered via ID post-CHIKV challenge. As indicated in Table 55, the 10 μg dose of CHIKV E2 mRNA mouse provided no protection post-CHIKV challenge when administered via IM or ID in a single dose. However, administration of CHIKV E2 mRNA via IM or ID using two doses provided 100% protection post-CHIKV challenge.

In all experiments, the negative control mice had a ~0% survival rate, as did the positive control mice (heat-inactivated CHIKV) which died prior to CHIKV challenge. Some mice died during the vaccination period.

Example 47

Efficacy of Chikungunya C-E3-E2-6K-E1 Antigen mRNA Vaccine Candidate

Figure 23A:
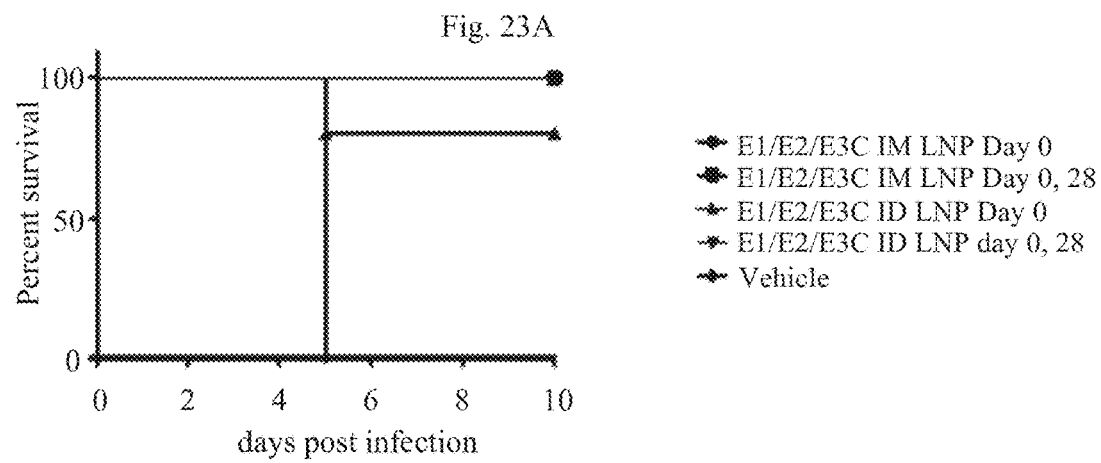
FIG. 23A is a graph showing the survival rates of AG129 mice vaccinated with a single 2 μg dose or two 2 μg doses of Chikungunya C-E3-E2-6K-E1 antigen administered either intramuscularly or intradermally.
Figure 23B:
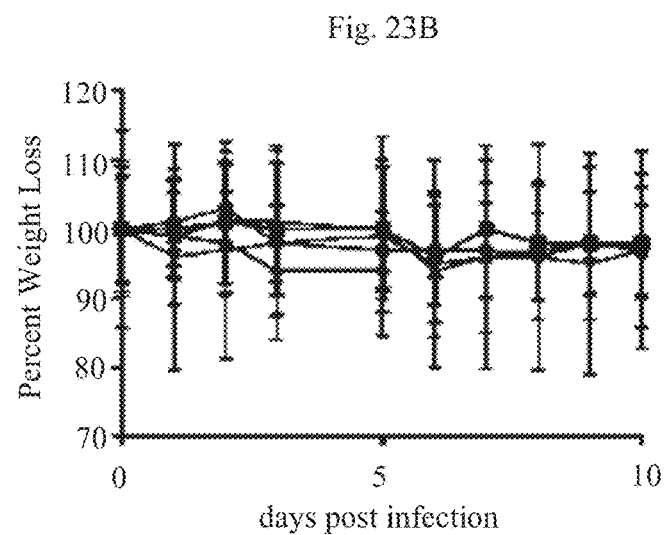
FIG. 23B is a graph showing the percent weight loss of AG129 mice vaccinated with a single 2 μg dose or two 2 μg doses of Chikungunya C-E3-E2-6K-E1 antigen administered either intramuscularly or intradermally.
Figure 23C:
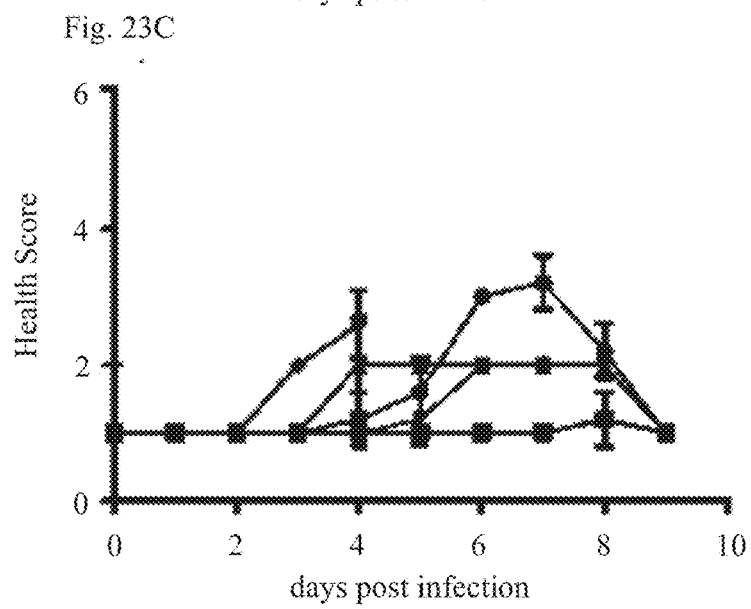
FIG. 23C is a graph showing the health scores of AG129 mice vaccinated with a single 2 μg dose or two 2 μg doses of Chikungunya C-E3-E2-6K-E1 antigen administered either intramuscularly or intradermally.
Figure 24A:
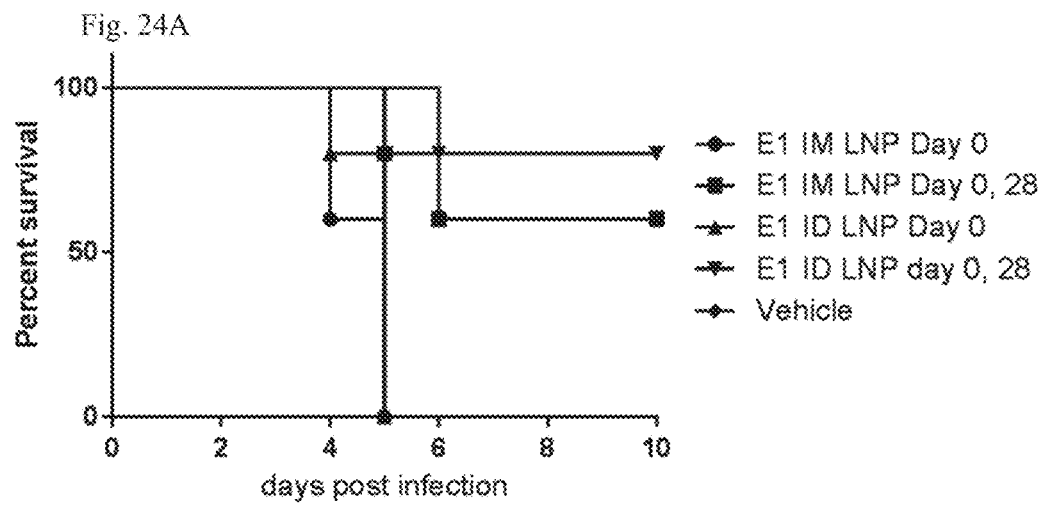
FIG. 24A is a graph showing the survival rates of AG129 mice vaccinated with a single 10 μg dose or two 10 μg doses of Chikungunya E1 antigen administered either intramuscularly or intradermally.
Figure 24B:
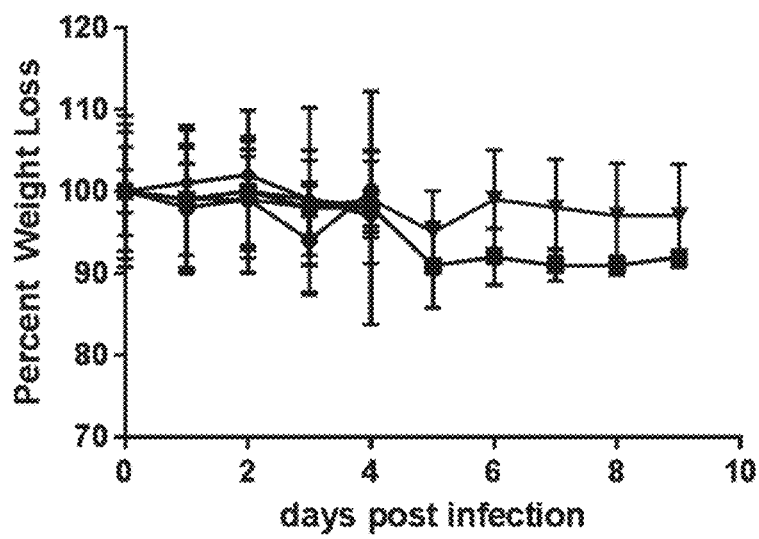
FIG. 24B is a graph showing the percent weight loss of AG129 mice vaccinated with a single 10 μg dose or two 10 μg doses of Chikungunya E1 antigen administered either intramuscularly or intradermally.
Figure 24C:
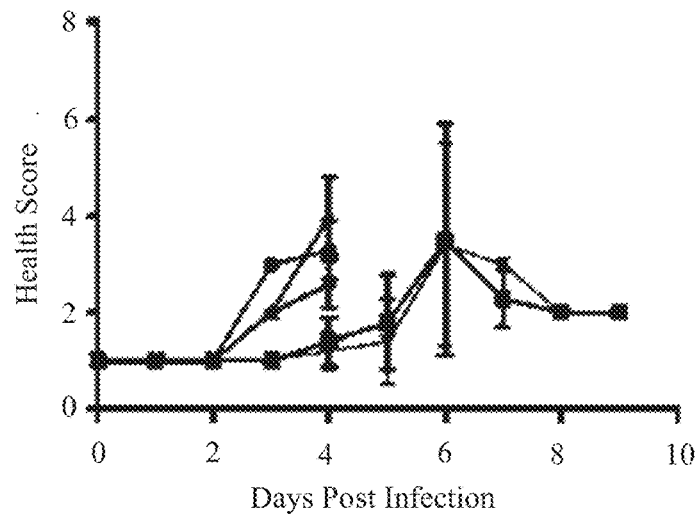
FIG. 24C is a graph showing the health scores of AG129 mice vaccinated with a single 10 μg dose or two 10 μg doses of Chikungunya E1 antigen administered either intramuscularly or intradermally.
Figure 26A:
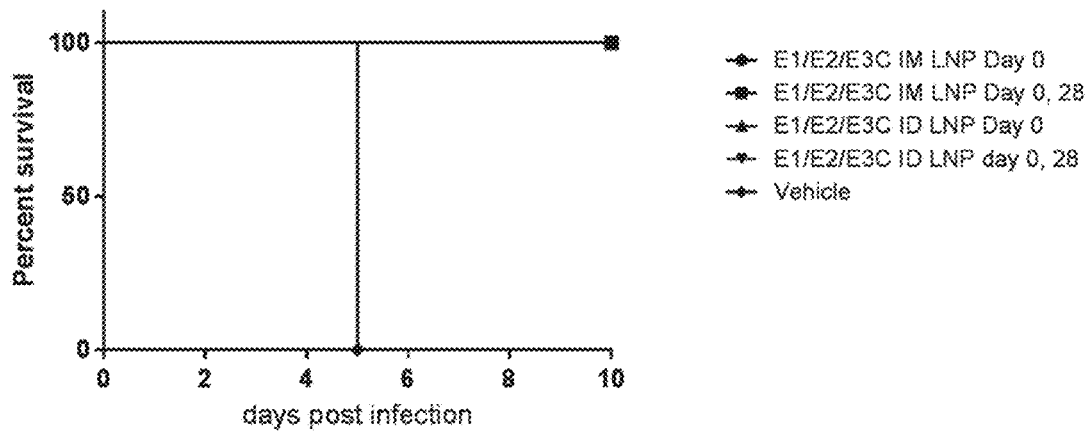
FIG. 26A is a graph showing the survival rates of AG129 mice vaccinated with a single 10 μg dose or two 10 μg doses of Chikungunya C-E3-E2-6K-E1 antigen administered either intramuscularly or intradermally.
Figure 26B:
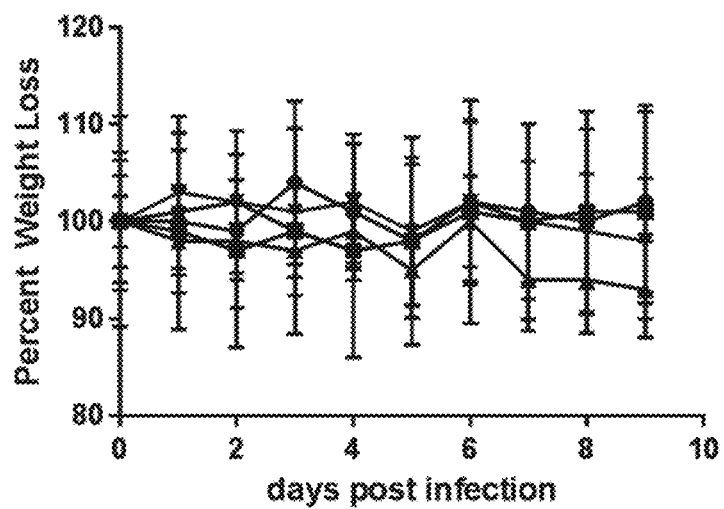
FIG. 26B is a graph showing the percent weight loss of AG129 mice vaccinated with a single 10 μg dose or two 10 μg doses of Chikungunya C-E3-E2-6K-E1 antigen administered either intramuscularly or intradermally.
Figure 26C:
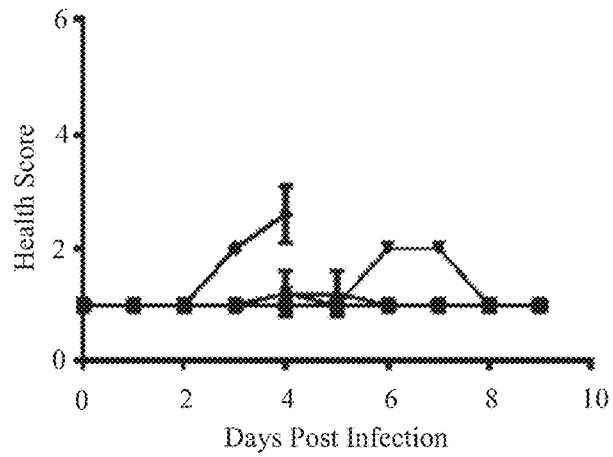
FIG. 26C is a graph showing the health scores of AG129 mice vaccinated with a single 10 μg dose or two 10 μg doses of Chikungunya C-E3-E2-6K-E1 antigen administered either intramuscularly or intradermally.
Figure 27A:
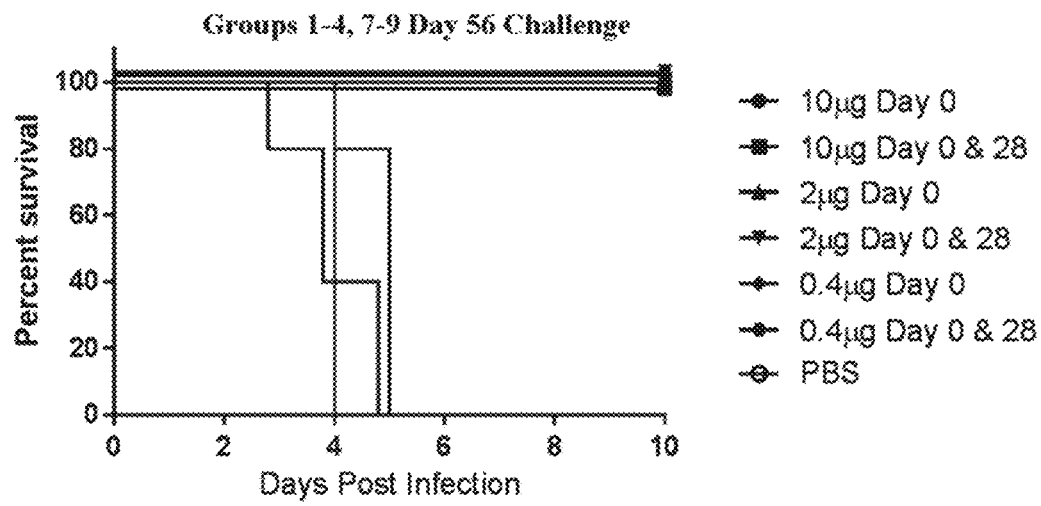
FIGS. 27A-27B are graphs showing the survival curves from a CHIKV challenge study in AG129 mice immunized with CHIKV mRNA vaccines in 10 μg, 2 μg, or 0.04 μg doses. Mice were divided into 14 groups (1-4 and 7-16, n=5).
Figure 27B:
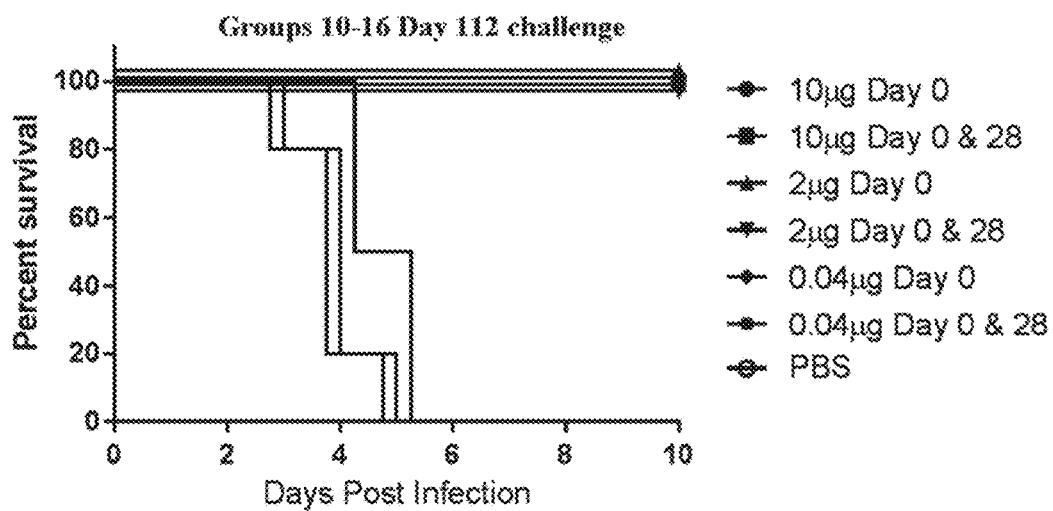
Figure 28A:
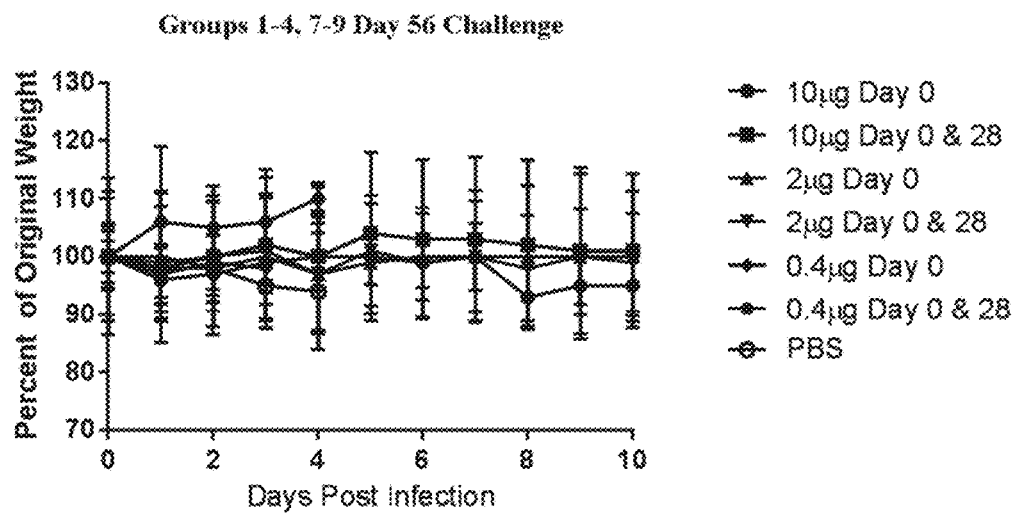
FIGS. 28A-28B are graphs showing the weight changes post challenge in AG129 mice immunized with CHIKV mRNA vaccines.
Figure 28B:
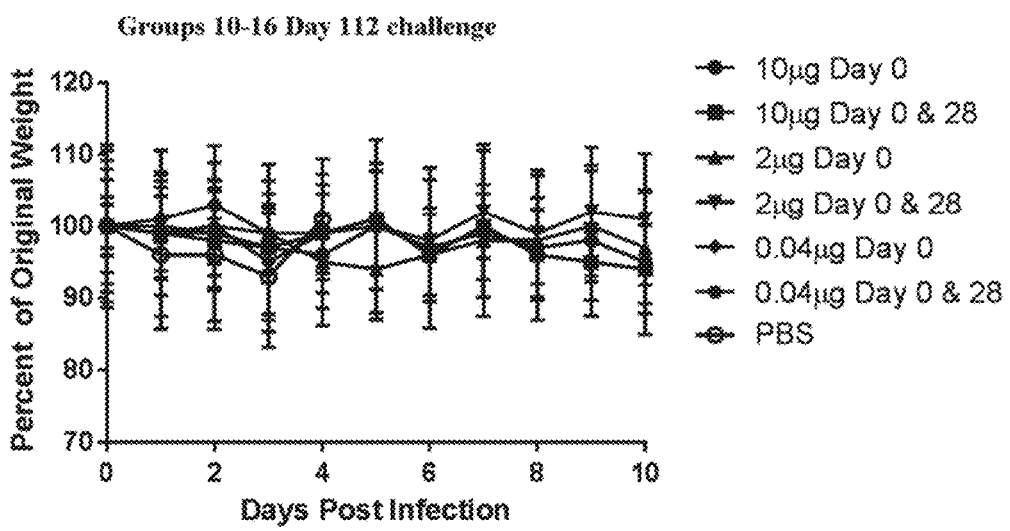
Figure 29A:
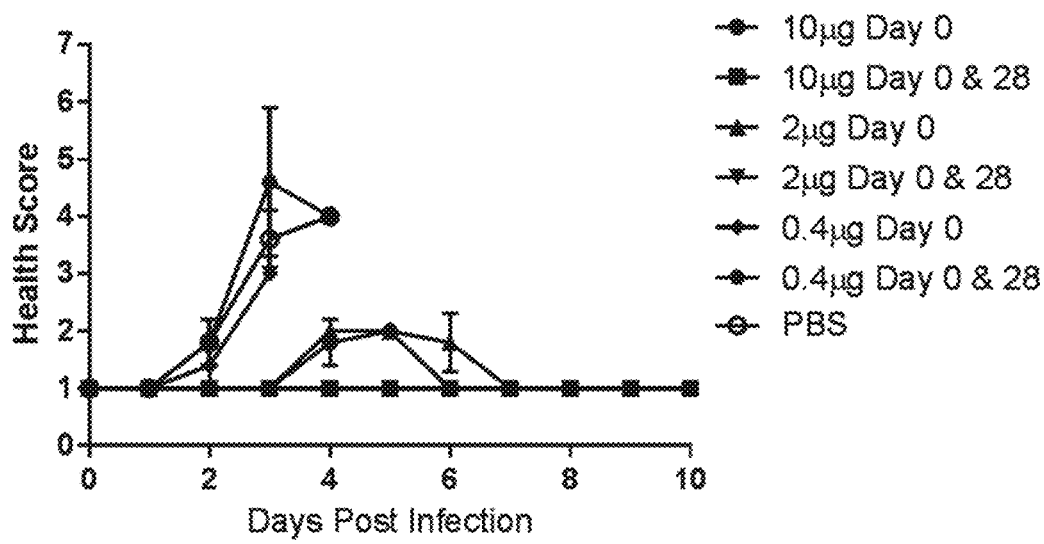
FIGS. 29A-29B are graphs showing the post challenge heath scores of AG129 mice immunized with CHIKV mRNA vaccines.
Figure 29B:
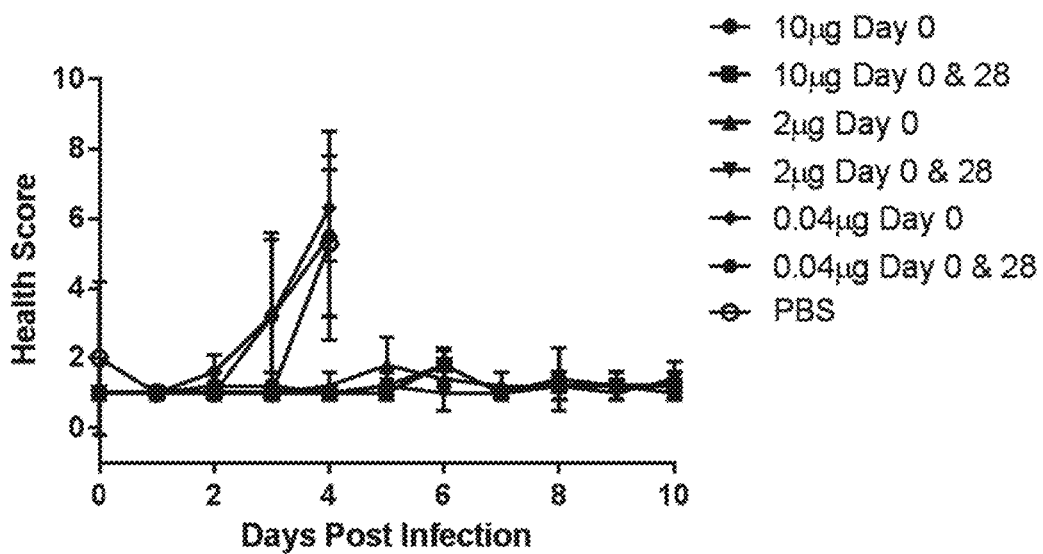
Figure 30C:
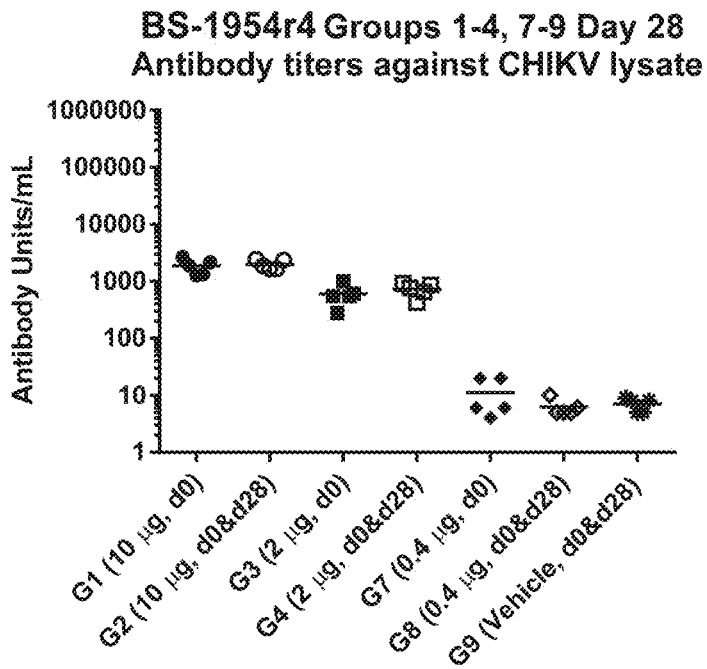
Figure 31A:
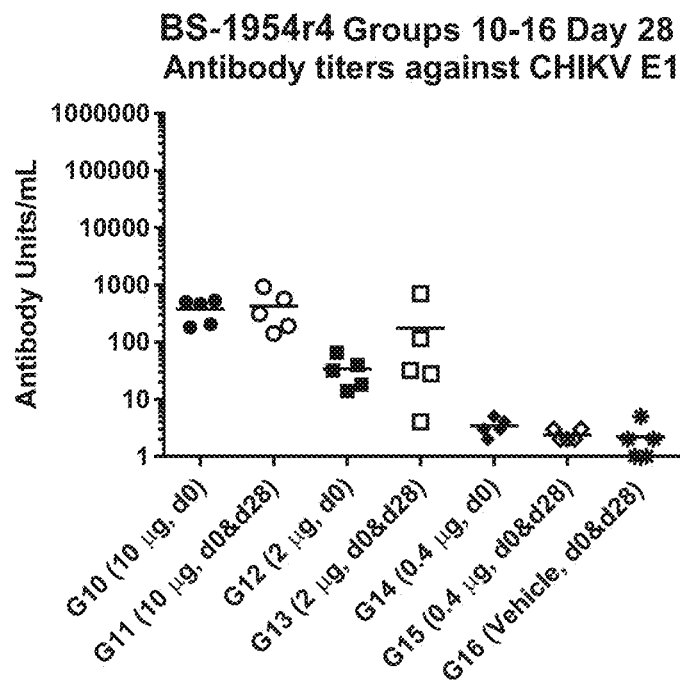
FIGS. 31A-31C are graphs showing the antibody titers measured by ELISA assays in the serum of AG129 mice (groups 10-16) 28 days post immunization with CHIKV mRNA vaccine.
Figure 31B:
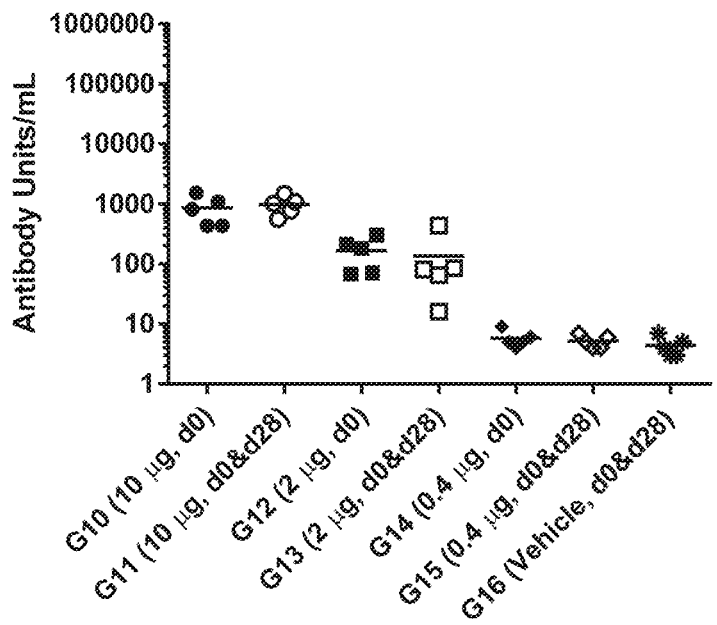
Figure 31C:
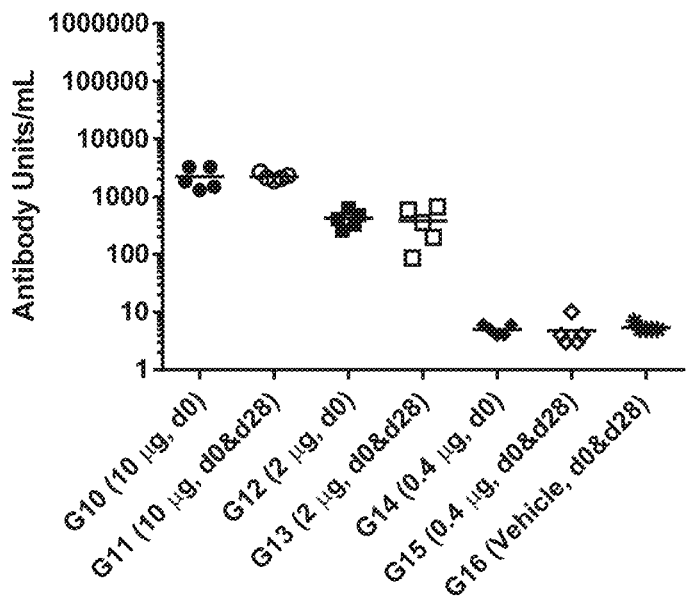
Figure 32A:
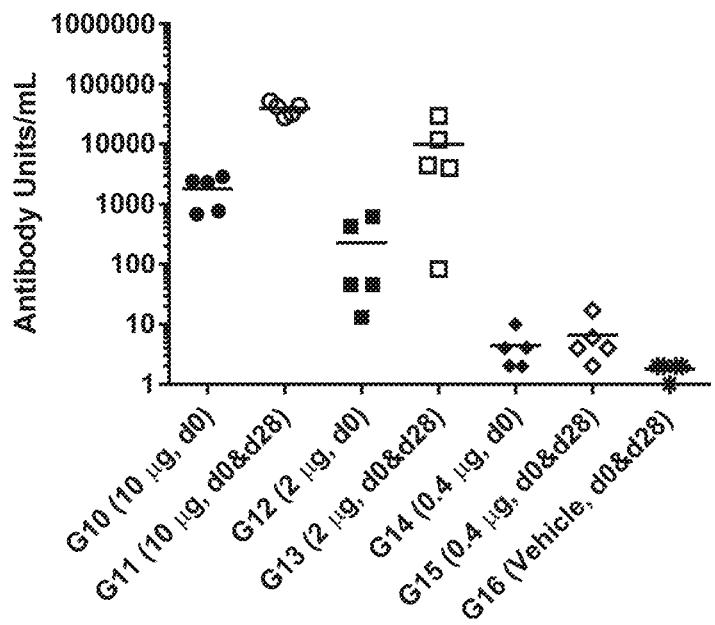
Figure 32B:
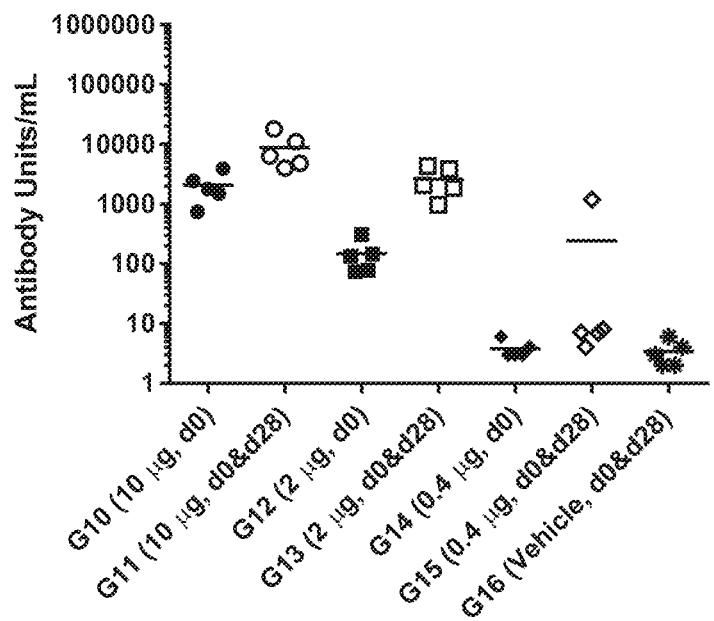

AG129 mice (n=5 per group) were vaccinated with 2 μg or 10 μg of MC-3-LNP formulated mRNA encoding CHIKV C-E3-E2-6K-E1 mRNA (SEQ ID NO: 388/401). The AG129 mice were vaccinated on either Day 0 or Days 0 and 28 via IM or ID delivery. On Day 56 following final vaccination all mice were challenged with a lethal dose of CHIKV. The survival curve, percent weight loss, and health status of the mice vaccinated with 2 μg CHIKV C-E3-E2-6K-E1 mRNA are shown in FIGS. 23A-23C. The survival results are tabulated in Table 56. The survival curve, percent weight loss, and health status of the mice vaccinated with 10 μg CHIKV C-E3-E2-6K-E1/E2/E3/C mRNA are shown in FIGS. 26A-26C. The survival results are tabulated in Table 57.

As shown in Table 56, the 2 μg dose of C-E3-E2-6K-E1 mRNA vaccine provided 100% protection post-CHIKV challenge when administered via IM in a single dose and provided 80% protection post-CHIKV challenge when administered via ID in a single dose. The 2 μg dose of C-E3-E2-6K-E1 mRNA vaccine provided 100% protection post-CHIKV challenge when administered via IM or ID in two doses. As shown in Table 57, the 10 μg dose of C-E3-E2-6K-E1 mRNA vaccine provided 100% protection post-CHIKV infection challenge when administered via IM or ID in either a single dose or in two doses.

In all experiments, the negative control mice had a ~0% survival rate, as did the positive control mice (heat-inactivated CHIKV) which died prior to CHIKV challenge. Some mice died during the vaccination period.

Example 48

Summary of Survival Data Using Chikungunya Antigen mRNA Vaccine Candidates CHIKV E1, CHIKV E2, and CHIKV C-E3-E2-6K-E1

Table 58 shows the survival data of the mice vaccinated with the CHIKV mRNA antigens used in the studies reported in Examples 45-47.

Example 49

In Vitro Transfection of mRNA-Encoded Chikungunya Virus Envelope Protein

The in vitro transfection of mRNA encoding Notch and a PBS control were performed in 150 k HeLa cells/well transfected with 1 μg mRNA+2 μL LF2000/well in a 24 well plate. Lysate containing proteins expressed from the CHIKV envelope mRNAs transfected in HeLa cells were collected 16 hours post-transfection and then detected by Western blotting with a V5 tag-HRP antibody. The successful detection of a CHIKV envelope protein is shown in FIG. 20.

Example 50

Detection of Immunity (Mouse IgG) Against Either Chikungunya-Specific E1, Chikungunya-Specific E2, or Chikungunya-Specific E1 and E2 Proteins Serum samples from mice vaccinated with the CHIKV E1, E2, or E1-E2-E3-C vaccine described in Examples 45-47 were tested using a semi-quantitative ELISA for the detection of mouse IgG against either Chikungunya-specific E1, Chikungunya-specific E2, or Chikungunya-specific E1 and E2 proteins.

Fifteen groups of five mice were vaccinated via intradermal (ID) or intramuscular (IM) injection with either 2 μg or 10 μg of the candidate vaccine. The vaccines were given to AG129 mice as single or two doses (second dose provided 28 days after the first dose). On day 56, mice were challenged with 1×10⁴ PFU of CHIKV via ID injection in 50 μL volume and monitored for 10 days for weight loss, morbidity, and mortality. Mice were bled on day 7 and day 28 post-vaccination via the peri-orbital sinus (retro-orbital bleed). In addition, mice surviving the CHIKV challenge were bled 10 days post-challenge.

Figure 36:
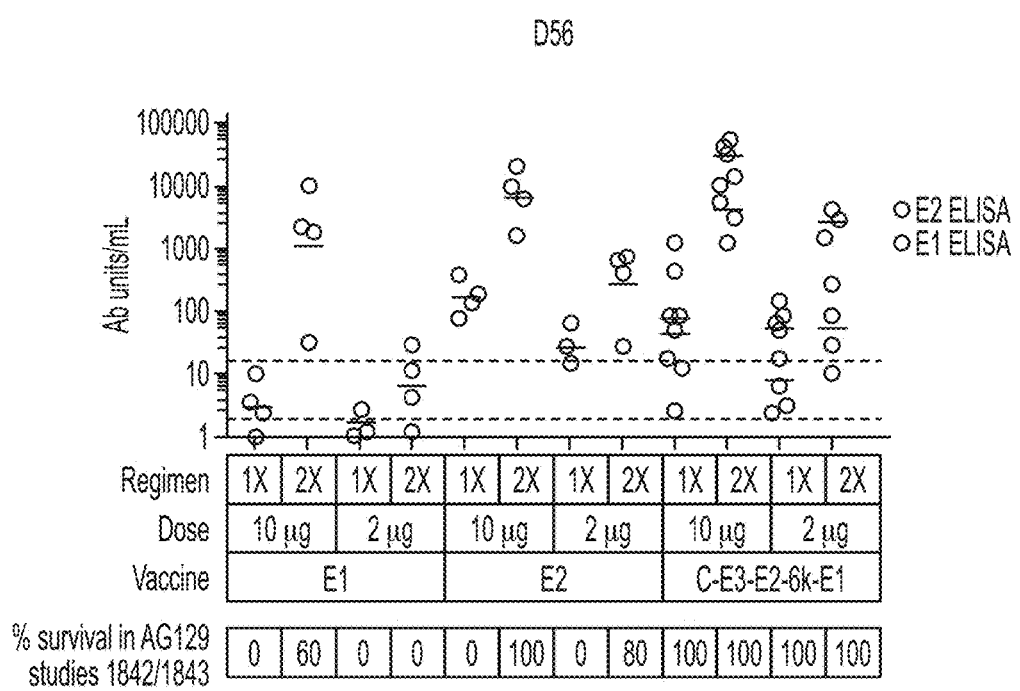
FIG. 36 is a graph depicting comparison of ELISA titers from the data of FIG. 34 to survival in the data of FIG. 35 left panel.

The individual samples were tested for reactivity in a semi-quantitative ELISA for mouse IgG against either Chikungunya-specific E1, Chikungunya-specific E2, or Chikungunya-specific E1 and E2 proteins. The results are shown in FIGS. 34-36.

The data depicting the results of the ELISA assay to identify the amount of antibodies produced in AG129 mice in response to vaccination with mRNA encoding secreted CHIKV E1 structural protein, secreted CHIKV E2 structural protein, or CHIKV full structural polyprotein C-E3-E2-6k-E1 at a dose of 10 μg or 2 μg at 28 days post immunization is shown in FIGS. 34-35. The 10 μg of mRNA encoding CHIKV polyprotein produced significant levels of antibody in both studies. The data depicting a comparison of ELISA titers from the data of FIG. 34 to survival in the data of FIG. 35 left panel is shown in FIG. 36. As shown in the survival results, the animals vaccinated with either dose (single or double administration) of mRNA encoding CHIKV polyprotein had 100% survival rates.

Example 51

Efficacy of Chikungunya Polyprotein (C-E3-E2-6K-E1) mRNA Vaccine Candidate

AG129 mice (n=5 per group) were vaccinated with either 10 μg, 2 μg or 0.4 μg of MC-3-LNP formulated mRNA encoded CHIKV polyprotein (C-E3-E2-6K-E1) (SEQ ID NO: 388/401). The mice were vaccinated on either Day 0 or Days 0 and 28 via IM delivery. In one study, all mice were challenged on day 56 with a lethal dose of CHIKV following final vaccination. In another study, all mice were challenged on day 84 with a lethal dose of CHIKV following final vaccination. The survival curve, percent weight loss, and health status of the mice vaccinated with 10 μg, 2 μg or 0.4 μg mRNA were determined as described previously in Examples 45-47. The survival rates, neutralizing antibodies and binding antibodies were assessed. Neutralizing antibodies were also identified against three different strains of CHIKV.

Figure 37:
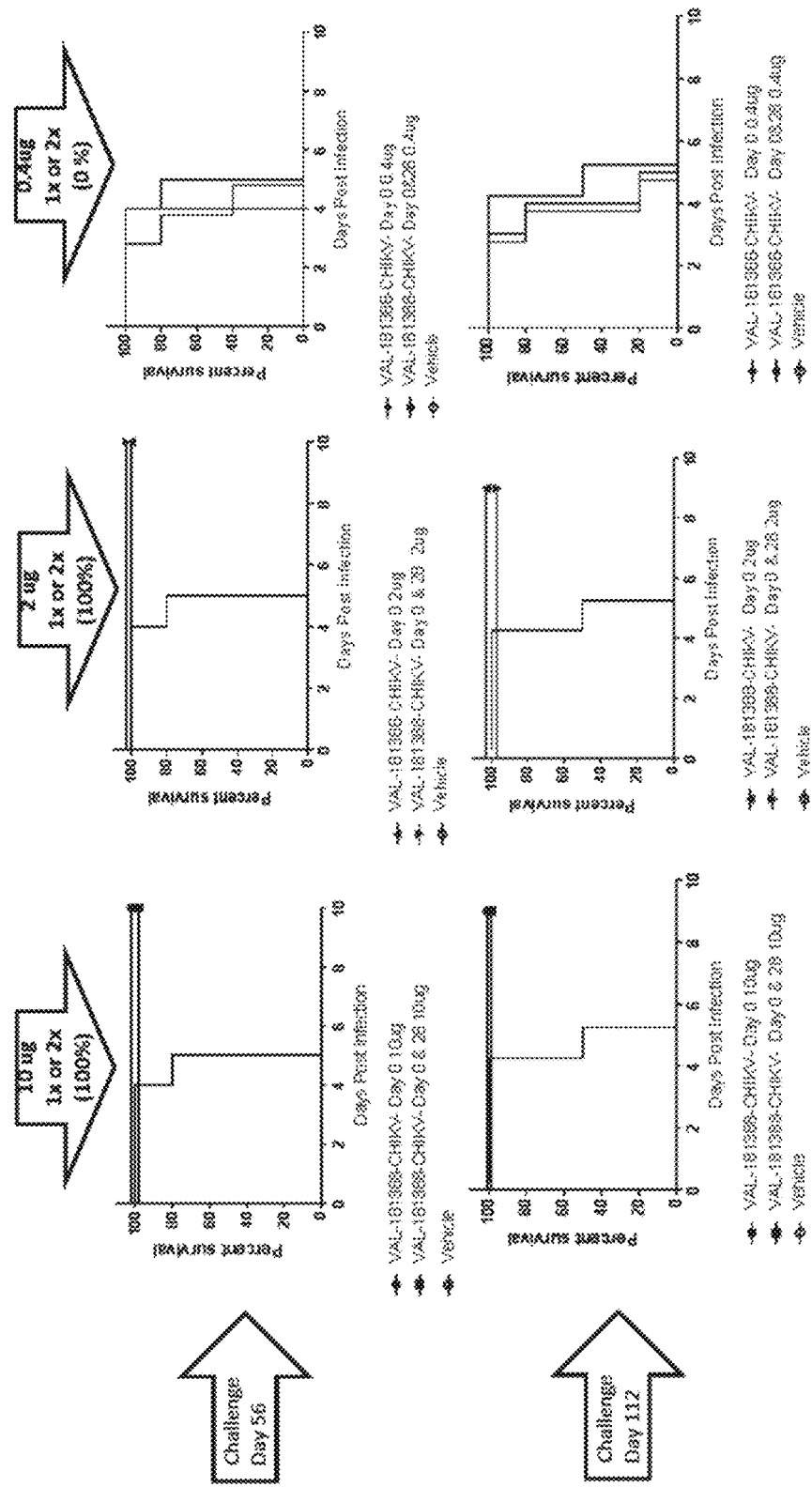
FIG. 37 shows a set of graphs depicting efficacy results in mice in response to vaccination with mRNA encoding CHIKV full structural polyprotein C-E3-E2-6k-E1 at a dose of 10 µg (left panels), 2 µg (middle panels) or 0.4 µg (right panels) at 56 days (top panels) or 112 days (bottom panels) post-immunization.

The survival rates of the mice vaccinated with mRNA encoding CHIKV C-E3-E2-6k-E1 is shown in FIG. 37. The data depicts vaccination at a dose of 10 μg (left panels), 2 μg (middle panels) or 0.4 μg (right panels) at 56 days (top panels) or 112 days (bottom panels) post immunization. These data demonstrate that a single 2 μg dose of the mRNA vaccine afforded 100% protection for at least 112 days (16 weeks). Following the study out further, the data demonstrated that a single 2 μg dose of the mRNA vaccine afforded 100% protection for at least 140 days (20 weeks.)

Figure 38:
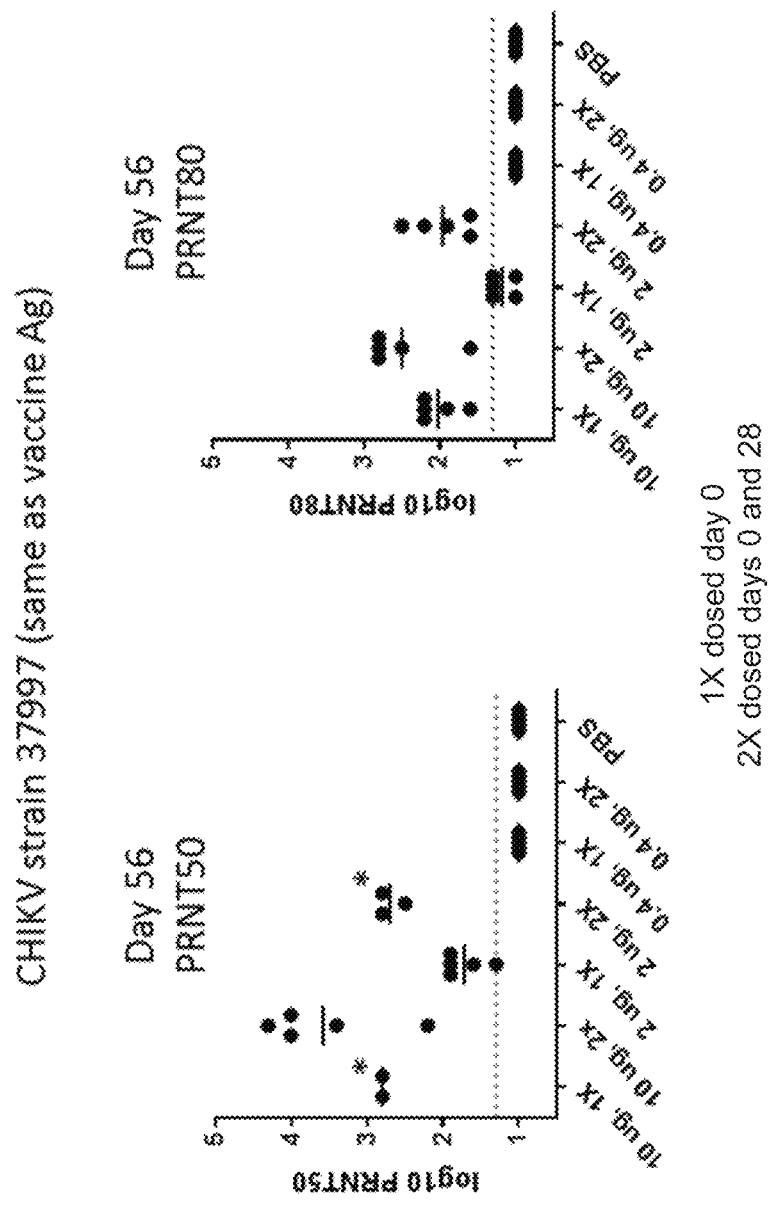
FIG. 38 shows a set of graphs depicting amount of neutralizing antibody produced in mice in response to vaccination with mRNA encoding CHIKV full structural polyprotein C-E3-E2-6k-E1 at a dose of 10 µg, 2 µg, or 0.4 µg at 56 days post immunization.
Figure 39:
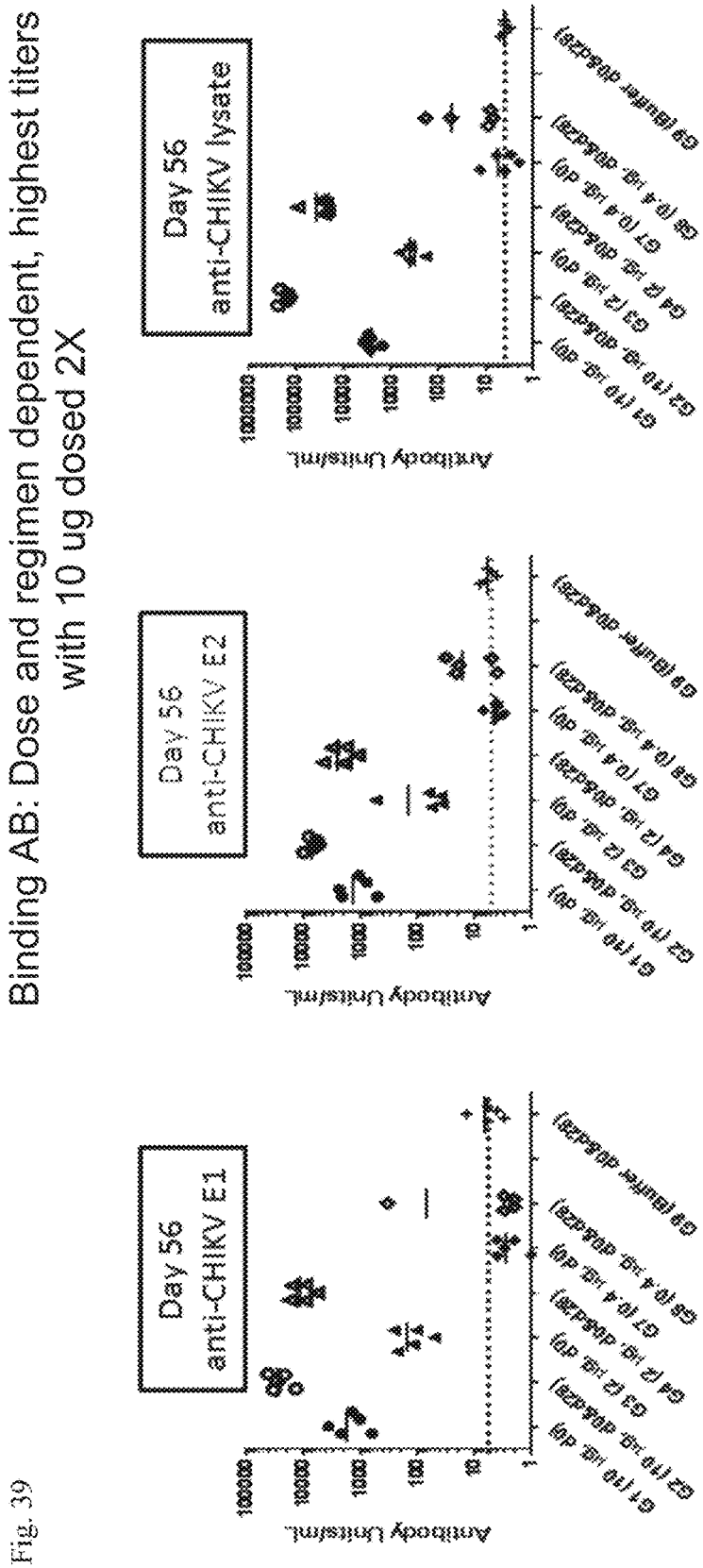
FIG. 39 shows a set of graphs depicting binding antibody produced in mice in response to vaccination with mRNA encoding CHIKV full structural polyprotein C-E3-E2-6k-E1 at a dose of 10 µg, 2 µg, or 0.4 µg at 56 days post immunization (top panels) and the corresponding correlation between binding and neutralizing antibodies (bottom panels).
Figure 39:
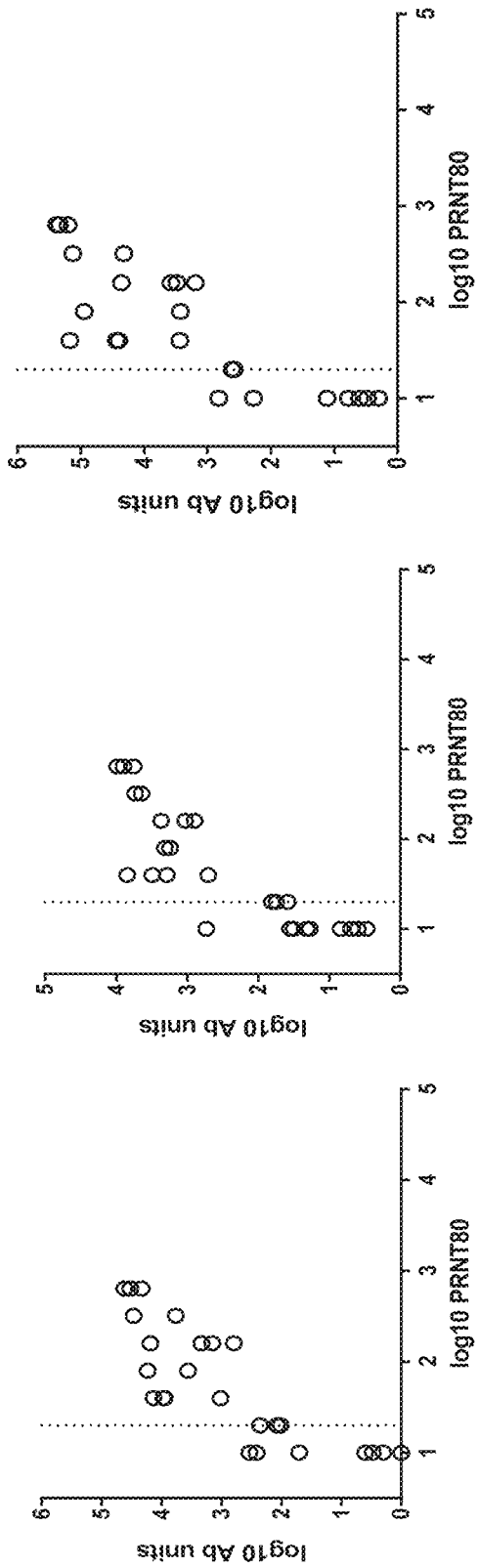

The neutralizing antibody and binding antibody produced in treated mice is shown in FIGS. 38 and 39, respectively. As can be seen in FIGS. 38 and 39, the levels of neutralizing antibody were dependent or dose and regimen with the highest titers evident with 10 μg dosed twice (days 0 and 28). Plaque reduction neutralization tests (PRNT50 and PRNT80) were used to quantify the titer of neutralizing antibody for the virus. Antigen-binding Ab was determined by ELISA. The corresponding correlation between binding Ab and neutralizing antibodies is shown in the bottom panels of FIG. 39. Following the study out to 16 weeks showed that the highest E1 titers were achieved when 10 μg mRNA vaccine was dosed twice.

Figure 41:
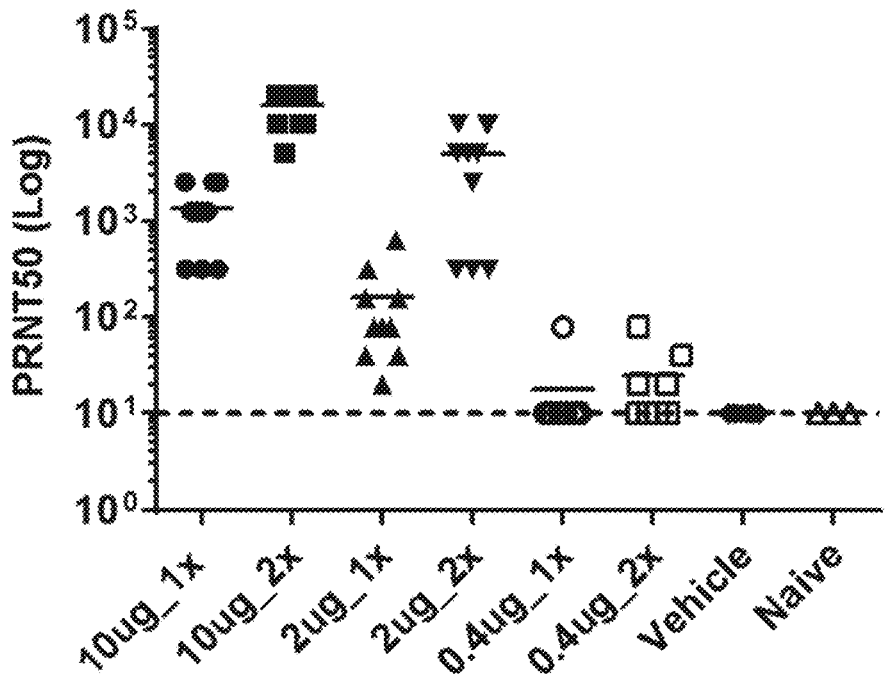
FIG. 41 shows a graph depicting neutralizing antibodies against CHIKV S27 strain.

The data depicting neutralizing antibodies against three different strains of CHIKV is shown in FIG. 40. The neutralizing antibodies were tested against three different strains of CHIKV, African-Senegal (left panel), La Reunion (middle panel) and CDC CAR (right panel). FIG. 40 shows that the polyprotein-encoding mRNA vaccine elicited broadly neutralizing antibodies against the three strains tested. Sera were further tested against Chik S27 strain (Chikungunya virus (strain S27-African prototype). The data depicting neutralizing antibodies against CHIKV S27 strain is shown in FIG. 41. These data collectively show that the polyprotein encoding mRNA vaccine elicited broadly neutralizing antibodies against all four strains tested. The vaccine induced neutralizing antibodies against multiple strains of Chikungunya. The prime and boost with the 10 μg dose produced the most robust neutralizing antibody response followed by the single dose with 10 μg.

Example 52

Transfection of mRNA Encoded CHIKV Structural Proteins

In vitro transfection of mRNA encoding CHIKV structural proteins and PBS control were performed in 400 k HeLa cells transfected with 1.25 ug mRNA lipoplexed with 5 ul LF2000/well in 6 well plate. Protein detection in HeLa cell lysate 16h post transfection was measured. Lysates which contain proteins expressed from the CHIKV mRNAs transfected in HeLa were collected 16h post transfection. Proteins were detected by WB with anti-Flag or and V5 antibody.

The mRNA encoded CHIKV structural proteins and protein production in the HeLa cell lysate 16h post transfection was detected.

Example 53

Exemplary CHIKV Polypeptides

The amino acids presented in the Table 48 are exemplary CHIKV antigenic polypeptides. To the extent that any exemplary antigenic peptide described herein includes a flag tag or V5, or a polynucleotide encodes a flag tag or V5, the skilled artisan understands that such flag tag or V5 is excluded from the antigenic polynucleotide in a vaccine formulation. Thus, any of the polynucleotides encoding proteins described herein are encompassed within the compositions of the invention without the flag tag or V5 sequence.

Example 54

Efficacy of CHIKV mRNA Vaccine X Against CHIKV in AG129 Mice Study Design

Chikungunya virus (CHIKV) 181/25 strain is an attenuated vaccine strain that was developed by the US Army via multiple plaque-to-plaque passages of the 15561 Southeast Asian human isolate (Levitt et al.). It is well tolerated in humans and is highly immunogenic. It produces small plaques and has decreased virulence in infant mice and nonhuman primates. When the attenuated virus is administered to immunodeficient AG129 mice (lacking the IFN-α/β and γ receptors) the mice succumb to a lethal disease within 3-4 days with ruffled fur and weight loss (Partidos, et al. 2011 *Vaccine*).

This instant study was designed to evaluate the efficacy of CHIKV candidate vaccines as described herein in AG129 mice (Table 59). The study included 14 groups of female 6-8 week old AG129 mice (Table 59). Groups 1-4, 7-8, and 10-15 were vaccinated with CHIKV vaccine X via the intramuscular (IM; 0.05 mL) route on Day 0 and select groups received an additional boost on Day 28. Control Groups 9 and 16 received vehicle (PBS) only on Days 0 and 28 via IM route (0.05 mL). Regardless of vaccination schedule, Groups 1-4 and 7-9 were challenged on Day 56 while Groups 10-16 were challenged on Day 112 using the CHIKV 181/25 strain (stock titer 3.97×10$^7$ PFU/mL, challenge dose 1×10$^4$ PFU/mouse). For virus challenge, all mice received a lethal dose (1×10$^4$ PFU) of Chikungunya (CHIK) strain 181/25 via intradermal (ID) route (0.050 mL via footpad). All mice were monitored for 10 days post infection for weight loss, morbidity, and mortality. Each mice was assigned a heath score based on Table 51. Mice displaying severe illness as determined by >30% weight loss, a health score of higher than 5, extreme lethargy, and/or paralysis were euthanized with a study endpoint of day 10 post virus challenge. Test bleeds via retro-orbital (RO) collection were performed on mice from all groups on Days −3, 28, and 56. Mice from Groups 10-16 were also bled on Days 84 & 112. Mice that survived challenge were also terminally bled on Day 10 post challenge. Serum samples from mice (Days −3, 28, 56, 84, 112 and surviving mice) were kept frozen (−80° C.) and stored until they were tested for reactivity in a semi quantitative ELISA for mouse IgG against either E1, E2 or CHIKV lysate.

Experimental Procedure
Intramuscular (IM) Injection of Mice
1. Restrain the animal either manually, chemically, or with a restraint device.
2. Insert the needle into the muscle. Pull back slightly on the plunger of the syringe to check proper needle placement. If blood is aspirated, redirect the needle and recheck placement again.

3. Inject appropriate dose and withdraw needle. Do not exceed maximum volume. If the required volume exceeds the maximum volume allowed, multiple sites may be used with each receiving no more than the maximum volume.

4. The injection site may be massaged gently to disperse the injected material.

Intradermal (ID) Injections of Mice

1. Restrain the animal either manually, chemically, or with a restraint device.

2. Carefully clip the hair from the intended injection site. This procedure can be done upon animals arriving or the day before any procedures or treatments are required.

3. Lumbar area is the most common site for ID injections in all species, but other areas can be used as well.

4. Pinch or stretch the skin between your fingers (or tweezers) to isolate the injection site.

5. With the beveled edge facing up, insert the needle just under the surface between the layers of skin. Inject the appropriate dose and withdraw needle. A small bleb will form when an ID injection is given properly.

6. If the required volume exceeds the maximum volume allowed, multiple sites may be used with each receiving no more than the maximum volume.

Retro-orbital Bleeding in Mice

1. Place the mice in the anesthesia chamber and open oxygen line and set to 2.5% purge. Start flow of anesthesia at 5% isoflurane.

2. Once the animal becomes sedate, turn anesthesia to 2.5%-3% isoflurane and continue to expose the animal to the anesthesia. Monitor the animal to avoid breathing becoming slow.

3. Remove the small rodent from anesthesia chamber and place on its back while restraining with left hand and scruff the back of the animal's neck, so it is easy to restrain and manipulate while performing the procedure with the right hand.

4. With a small motion movement, place the capillary tube in the corner of the animal's eye close to the nostril, and rotate or spin the Hematocrit glass pipette until blood start flowing out. Collect the appropriate amount of blood needed into the appropriate labeled vial.

5. Monitor the animal after retro-orbital bleeding is done for at least 10-15 seconds to ensure hemostasis.

6. Place the animal back to its original cage and monitor for any other problems or issues caused while manipulating animal due to the procedure.

Observation of Mice

1. Mice were observed through 10 days post infection (11 days total, 0-10 days post infection).

2. Mice were weighed daily on an Ohause scale and the weights are recorded. 3. Survival and health of each mouse were evaluated once time a day using a scoring system of 1-7 described in Table 51.

Infection

On either Day 56 (Groups 1-4, 7-9) or Day 112 (Groups 10-16) groups of 5 female 6-8 week old AG129 mice were infected via intradermal injection with $1\times10^4$ PFU/mouse of the 181/25 strain of Chikungunya diluted in PBS. The total inoculation volume was 0.05 mL administered in the rear footpad of each animal. Mice were anesthetized lightly using 2-5% v/v of isoflurane at ~2.5 L/min of 02 (VetEquip IMPAC6) immediately prior to infection.

Dose Administration

In this study mice were administered 0.04 μg, 2 μg, or 10 μg of various formulations of the CHIKV vaccine X or vehicle alone (PBS) on either Day 0 or on Days 0 and 28 via the intramuscular route (0.05 mL). The material was pre-formulated and diluted in PBS by IBT prior to dosing.

Results

Mice were immunized once (Day 0) or twice (Days 0 & 28) with either 0.04 μg, 2 μg, or 10 μg of Chikungunya mRNA vaccine X and were challenged with CHIKV strain 181/25 on either Day 56 (Groups 1-4, 7-9) or on Day 112 (Groups 10-16). Mice were monitored for a total of 10 days post infection for health and weight changes. Mice that received either 2 μg or 10 μg of the CHIKV mRNA vaccine X either once (Day 0) or twice (Days 0 and 28) were fully protected (100%) regardless of whether the mice were challenged 56 days or 112 days after the initial vaccination (FIGS. 27A-27B, Table 44). Mice receiving 0.04 μg of the CHIKV mRNA vaccine were not protected at all from lethal CHIKV infection. This efficacy data is supported by the health scores observed in the vaccinated mice in that the protected mice displayed little to no adverse health effects of a CHIKV infection (FIGS. 29A-29B). Weight loss is not a strong indicator of disease progression in the CHIKV AG129 mouse model (FIGS. 28A-28B).

Mice immunized with the CHIKV mRNA vaccine X showed increased antibody titers against CHIKV E1, E2 and CHIKV lysate as compared to the vehicle only (PBS) treated groups. Serum binding against the virus lysate yielded the highest antibody titers for all vaccinated groups (FIGS. 30A-30C, 31A-31C, 32A-32C, 33A-33C). Overall, the antibody titers were dose dependent with the highest titers observed in serum from mice vaccinated with 10 μg of CHIKV mRNA vaccine X while the lowest titers were observed in serum from mice vaccinated with 0.04 μg of the CHIKV mRNA vaccine X. Similarly, higher titers were observed in serum from mice vaccinated twice (Days 0 and 28) as compared to serum from mice vaccinated only once (Day 0). Serum obtained on Day 112 post initial vaccination still yielded increased antibody titers in mice that received either 10 μg or 2 μg of CHIKV mRNA vaccine X (FIGS. 32A-32C).

Serum from mice groups 10-16, 112 days post immunization were also tested in a Plaque Reduction Neutralization Test (PRNT). Serum from each mice was diluted from 1/20 to 1/40960 and assessed for its ability to reduce CHIKV plaque formation. The results were shown in Table 64.

Example 55

Figure 42:
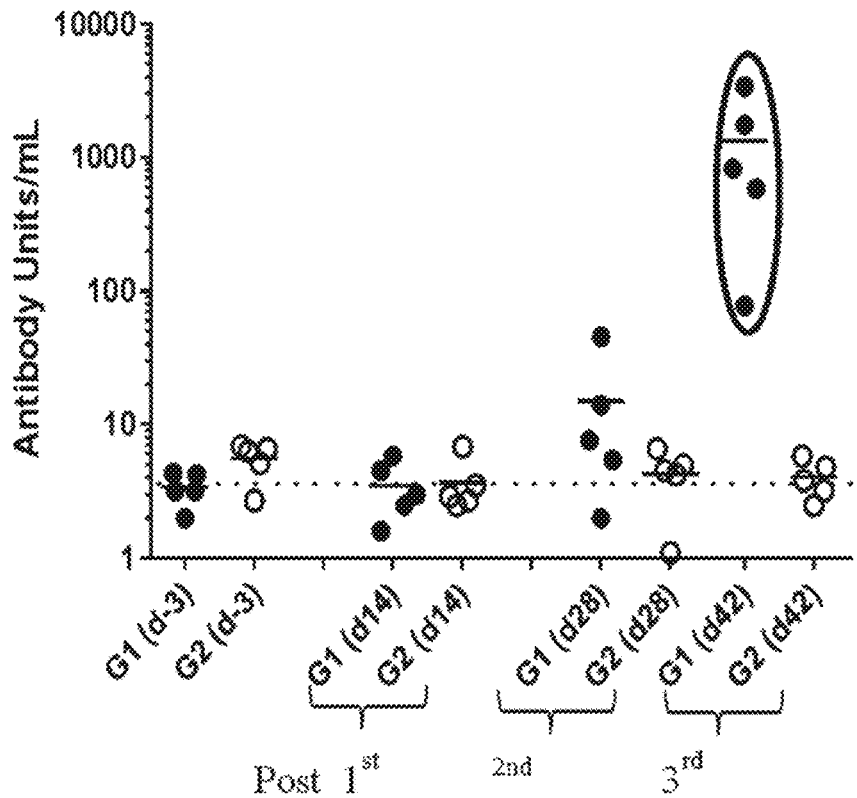
FIG. 42 is a graph depicting antibody titer against CHIKV lysate post 3rd vaccination 10 with the mRNA vaccine in Sprague Dawley rats.

Immunogenicity of Chikungunya Polyprotein (C-E3-E2-6K-E1) mRNA Vaccine Candidate in Rats Sprague Dawley rats (n=5) were vaccinated with 20 µg of MC-3-LNP formulated mRNA 30 encoded CHIKV polyprotein (C-E3-E2-6K-E1) (SEQ ID NO: 388/401). The rats were vaccinated on either Day 0 or Days 0 and 14 or Days 0, 14 and 28 via IM delivery. Sera were collected on days −3, 14, 28 and 42 for ELISA testing. FIG. 42 demonstrated that there was at least a two log increase in antibody titer against CHIKV lysate post 3rd vaccination with the mRNA vaccine in normal rats.

Example 56

Evaluation of T Cell Activation of Chikungunya P 5 Polyprotein (C-E3-E2-6K-E1) mRNA Vaccine Candidate C57BL/6 mice (n=6 experimental group; n=3 control group) were vaccinated with 10 µg of MC-3-LNP formulated mRNA encoded CHIKV polyprotein (C-E3-E2-6K-E1) (SEQ ID NO: 388/401). The mice were vaccinated on either Day 0 or Days 0 and 28 (boost) via IM delivery. Sera was collected on days 3, 28 and 42 for ELISA testing. Animals were sacrificed on day 42 and spleens were harvested for immunological evaluation of T cells. Splenic cells were isolated and analyzed by FACS. Briefly, spleens were removed, cells isolated, and stimulated in vitro with immunogenic peptides found within either C, E1, or E2 region of CHIKV that are known to be CD8 epitopes in B6 mice. The readout for this assay was cytokine secretion (IFN-gamma and TNF-alpha), which reveals whether the vaccine induced antigen-specific T cell responses. No CD8 T cell responses were detected using the E2 or C peptide (baseline levels of IFN-gamma and TNF-alpha), whereas there was a response to the E1-corresponding peptide (average of about 0.4% IFN-gamma and 0.1% TNF). The peptides were used to stimulate T cells used in the study were E1=HSMTNAVTI (SEQ ID NO: 414), E2=IILYYYELY (SEQ ID NO: 415), and C=ACLVGDKVM (SEQ ID NO: 416).

Figure 43:
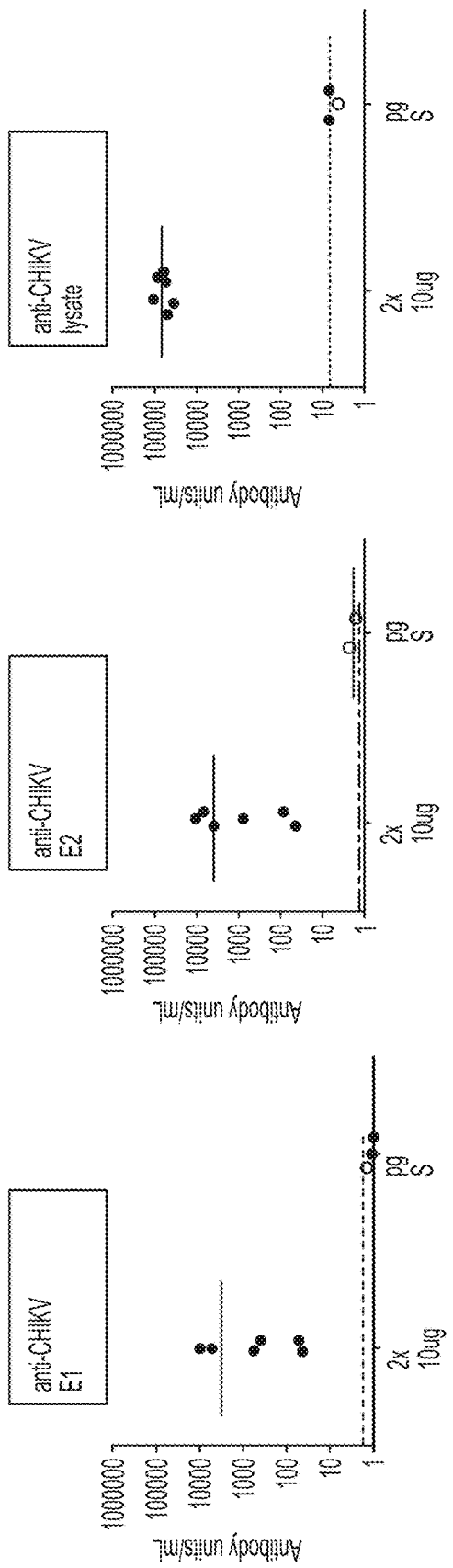
FIG. 43 shows a set of graphs depicting antibody titers following vaccination of mice with mRNA encoded CHIKV polyprotein (C-E3-E2-6K-E1).
Figure 44:
FIG. 44 shows a set of plots depicting cytokine secretion and T-cell activation following vaccination of mice with mRNA encoded CHIKV polyprotein (C-E3-E2-6K-E1).
Figure 44:
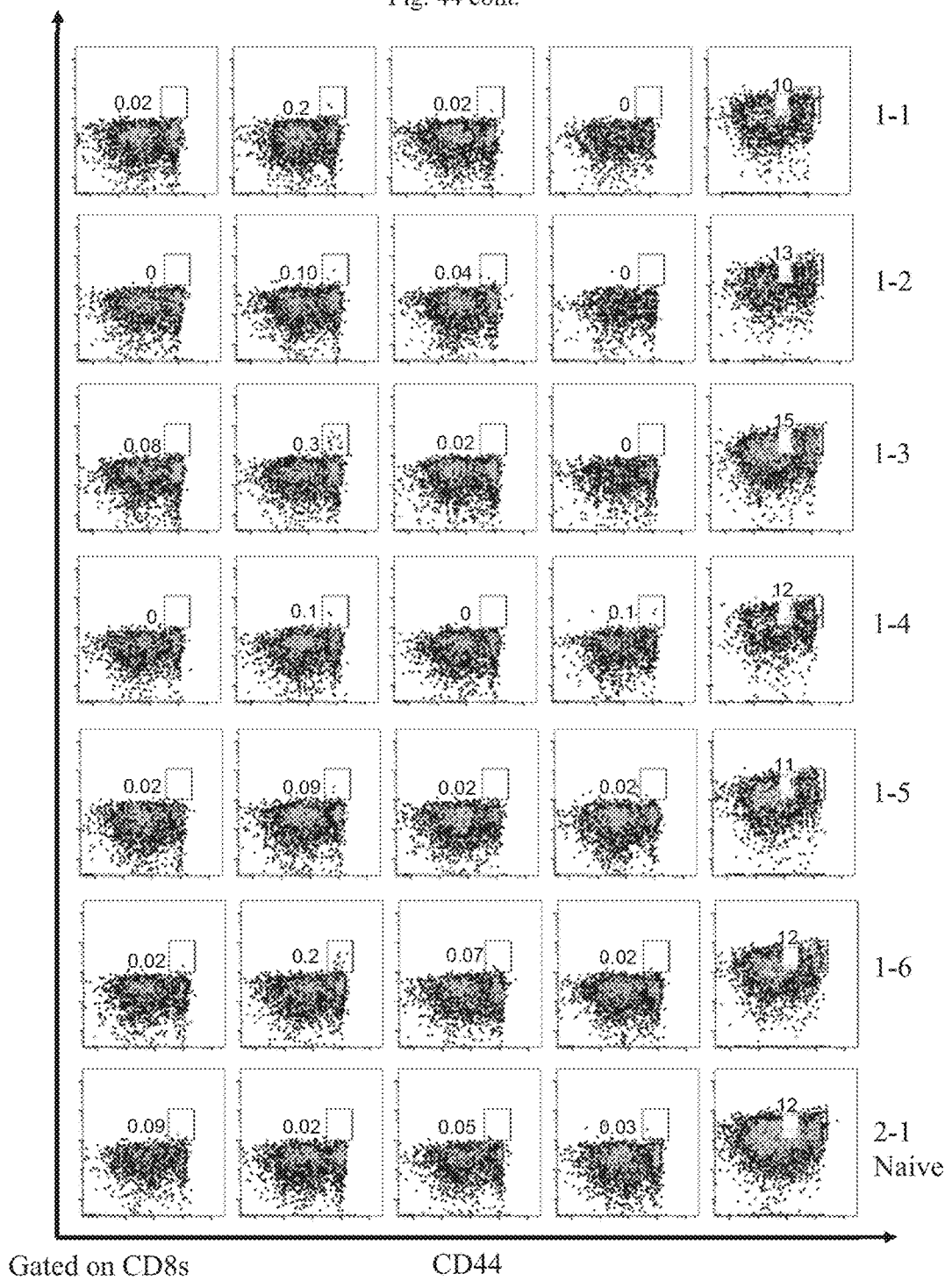
Figure 45A:
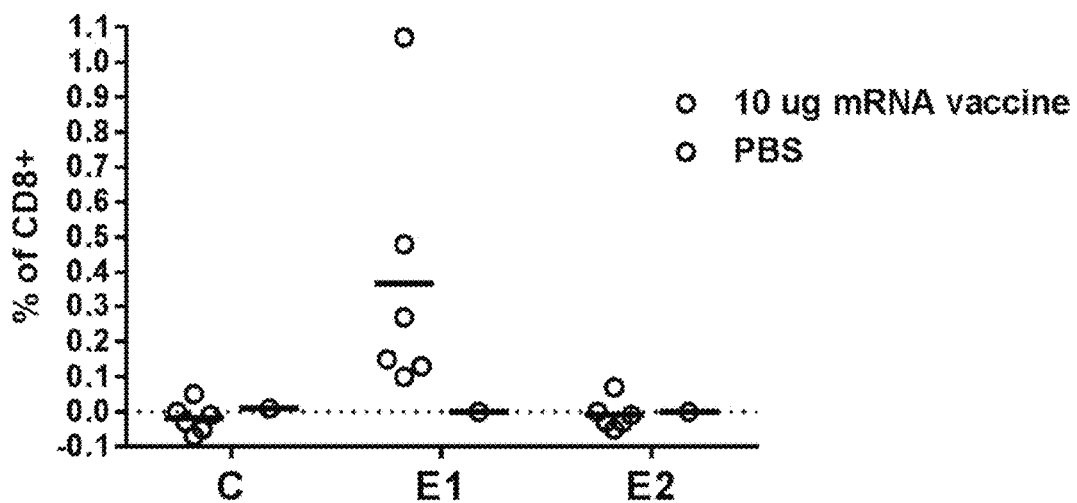
FIGS. 45A-45B show a set of graphs depicting CD8+ T cell activation following vaccination of mice with mRNA encoded CHIKV polyprotein (C-E3-E2-6K-E1).
Figure 45B:
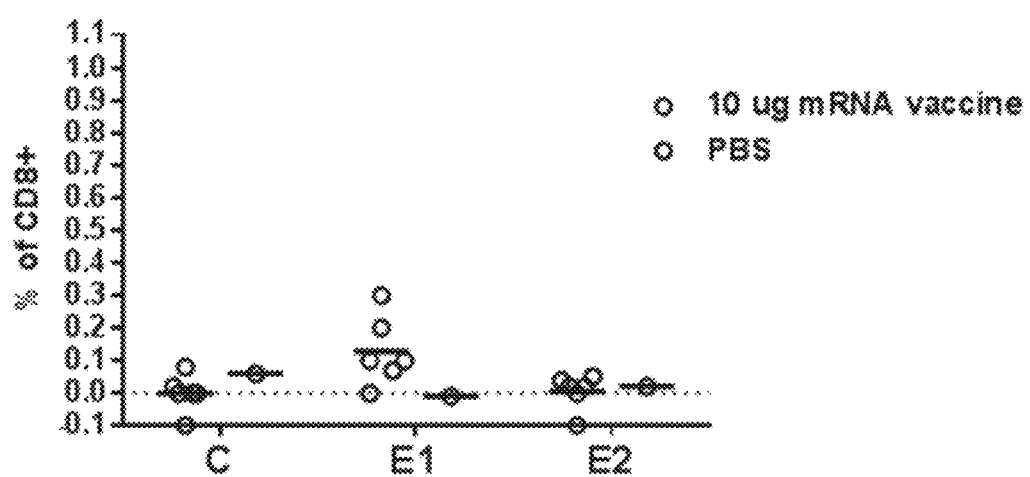

FIG. 43 shows that the polyprotein-encoding CHIKV polyprotein vaccine elicited high antibody titers against the CHIKV glycoproteins. FIGS. 44 and 45A-45B show T cell activation by E1 peptide.

Example 57

Proof-of-concept of Immunogenicity in Non-Human Primates

The mRNA vaccine was tested in Cynomolgus monkey subjects (n=3 per experimental group, n=3 negative control). Subjects were given an intramuscular (IM) immunization of 25 µg or 75 µg of the vaccine on day 0 (prime), day 28 (boost), and day 56 (boost). The negative control group was administered 75 µg of non-translated irrelevant mRNA (NTIX). The readout for this experiment was serum antibody titers (binding and neutralizing) and a CHIKV-specific T cell response.

As shown in FIG. 46, the vaccine induced a robust antibody response. A response was detected after the priming dose, and then increased with the boost, and increased slightly more following the third immunization. Both the 25 µg and 75 µg vaccine groups were immunogenic, and there was a small dose response. Neutralizing titers were a few fold lower than those seen in mice, but were still robust.

Figure 47:
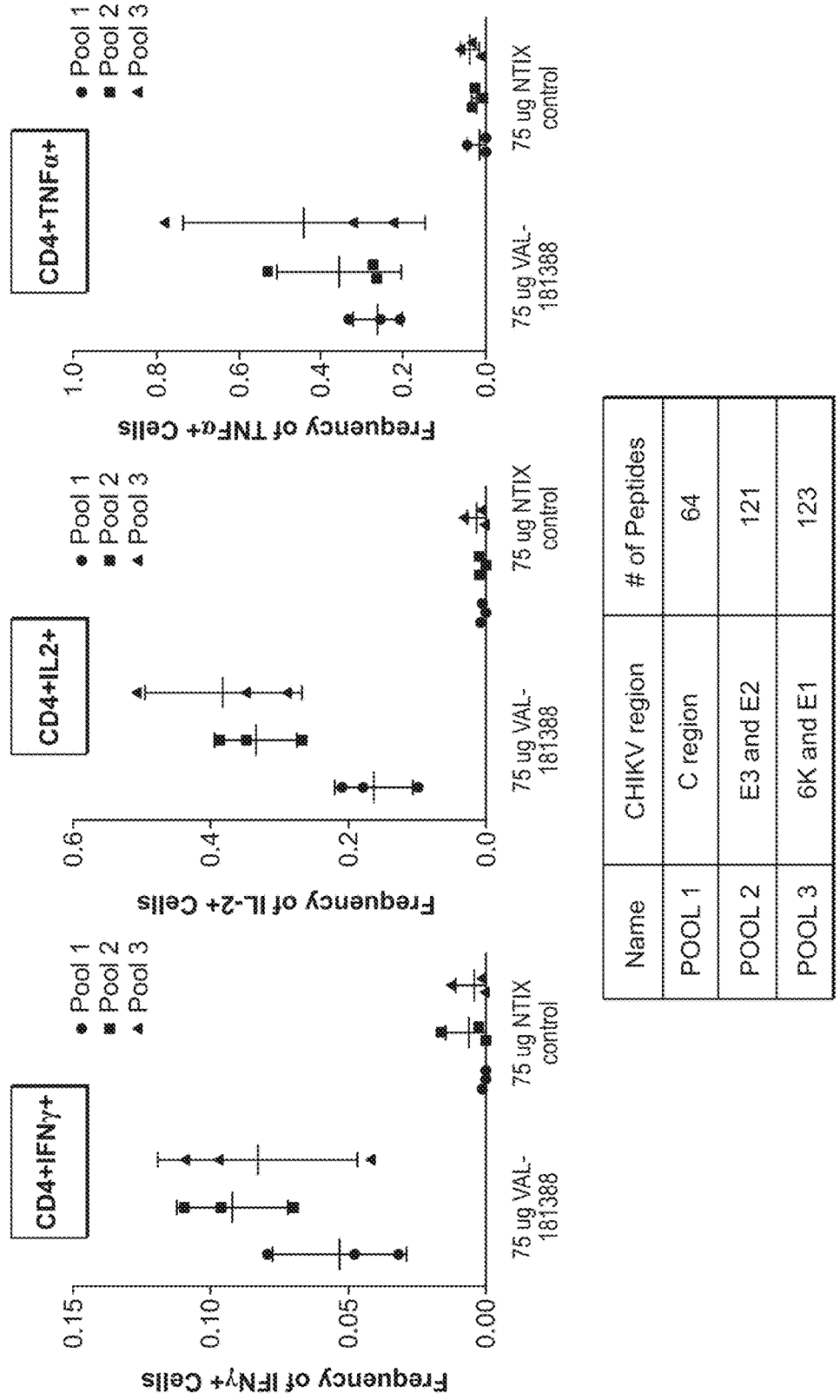
FIG. 47 shows a set of graphs depicting a robust CD4 response to a CHIKV vaccine in NHPs.

FIG. 47 shows a robust CD4 response in response to the vaccine. Day 35 T cells, measured one week after the second immunization, were assayed. The peptide pool consisted of 15mers overlapping by 11. The response was measured through peptide stimulation, followed by intracellular cytokine staining and flow cytometry. A CHIKV-specific CD4 T cell response was detected, mainly in IL-2 and TNFα. There was a minimal CD8 response as well.

Each of the sequences described herein encompasses a chemically modified sequence or an unmodified sequence (no modified nucleotides), which includes no nucleotide modifications.

---

Lengthy table referenced here

US10124055-20181113-T00001

Please refer to the end of the specification for access instructions.

---

Lengthy table referenced here

US10124055-20181113-T00002

Please refer to the end of the specification for access instructions.

---

Lengthy table referenced here

US10124055-20181113-T00003

Please refer to the end of the specification for access instructions.

---

Lengthy table referenced here

US10124055-20181113-T00004

Please refer to the end of the specification for access instructions.

---

Lengthy table referenced here

US10124055-20181113-T00005

Please refer to the end of the specification for access instructions.

---

Lengthy table referenced here

US10124055-20181113-T00006

Please refer to the end of the specification for access instructions.

| | |
|---|---|
| Lengthy table referenced here<br>US10124055-20181113-T00007<br>Please refer to the end of the specification for access instructions. | Lengthy table referenced here<br>US10124055-20181113-T00016<br>Please refer to the end of the specification for access instructions. |
| Lengthy table referenced here<br>US10124055-20181113-T00008<br>Please refer to the end of the specification for access instructions. | Lengthy table referenced here<br>US10124055-20181113-T00017<br>Please refer to the end of the specification for access instructions. |
| Lengthy table referenced here<br>US10124055-20181113-T00009<br>Please refer to the end of the specification for access instructions. | Lengthy table referenced here<br>US10124055-20181113-T00018<br>Please refer to the end of the specification for access instructions. |
| Lengthy table referenced here<br>US10124055-20181113-T00010<br>Please refer to the end of the specification for access instructions. | Lengthy table referenced here<br>US10124055-20181113-T00019<br>Please refer to the end of the specification for access instructions. |
| Lengthy table referenced here<br>US10124055-20181113-T00011<br>Please refer to the end of the specification for access instructions. | Lengthy table referenced here<br>US10124055-20181113-T00020<br>Please refer to the end of the specification for access instructions. |
| Lengthy table referenced here<br>US10124055-20181113-T00012<br>Please refer to the end of the specification for access instructions. | Lengthy table referenced here<br>US10124055-20181113-T00021<br>Please refer to the end of the specification for access instructions. |
| Lengthy table referenced here<br>US10124055-20181113-T00013<br>Please refer to the end of the specification for access instructions. | Lengthy table referenced here<br>US10124055-20181113-T00022<br>Please refer to the end of the specification for access instructions. |
| Lengthy table referenced here<br>US10124055-20181113-T00014<br>Please refer to the end of the specification for access instructions. | Lengthy table referenced here<br>US10124055-20181113-T00023<br>Please refer to the end of the specification for access instructions. |
| Lengthy table referenced here<br>US10124055-20181113-T00015<br>Please refer to the end of the specification for access instructions. | Lengthy table referenced here<br>US10124055-20181113-T00024<br>Please refer to the end of the specification for access instructions. |

Lengthy table referenced here
US10124055-20181113-T00025
Please refer to the end of the specification for access instructions.

Lengthy table referenced here
US10124055-20181113-T00026
Please refer to the end of the specification for access instructions.

Lengthy table referenced here
US10124055-20181113-T00027
Please refer to the end of the specification for access instructions.

Lengthy table referenced here
US10124055-20181113-T00028
Please refer to the end of the specification for access instructions.

Lengthy table referenced here
US10124055-20181113-T00029
Please refer to the end of the specification for access instructions.

Lengthy table referenced here
US10124055-20181113-T00030
Please refer to the end of the specification for access instructions.

Lengthy table referenced here
US10124055-20181113-T00031
Please refer to the end of the specification for access instructions.

Lengthy table referenced here
US10124055-20181113-T00032
Please refer to the end of the specification for access instructions.

Lengthy table referenced here
US10124055-20181113-T00033
Please refer to the end of the specification for access instructions.

Lengthy table referenced here
US10124055-20181113-T00034
Please refer to the end of the specification for access instructions.

Lengthy table referenced here
US10124055-20181113-T00035
Please refer to the end of the specification for access instructions.

Lengthy table referenced here
US10124055-20181113-T00036
Please refer to the end of the specification for access instructions.

Lengthy table referenced here
US10124055-20181113-T00037
Please refer to the end of the specification for access instructions.

Lengthy table referenced here
US10124055-20181113-T00038
Please refer to the end of the specification for access instructions.

Lengthy table referenced here
US10124055-20181113-T00039
Please refer to the end of the specification for access instructions.

Lengthy table referenced here
US10124055-20181113-T00040
Please refer to the end of the specification for access instructions.

Lengthy table referenced here
US10124055-20181113-T00041
Please refer to the end of the specification for access instructions.

Lengthy table referenced here
US10124055-20181113-T00042
Please refer to the end of the specification for access instructions.

Lengthy table referenced here
US10124055-20181113-T00043

Please refer to the end of the specification for access instructions.

Lengthy table referenced here
US10124055-20181113-T00044

Please refer to the end of the specification for access instructions.

Lengthy table referenced here
US10124055-20181113-T00045

Please refer to the end of the specification for access instructions.

Lengthy table referenced here
US10124055-20181113-T00046

Please refer to the end of the specification for access instructions.

Lengthy table referenced here
US10124055-20181113-T00047

Please refer to the end of the specification for access instructions.

Lengthy table referenced here
US10124055-20181113-T00048

Please refer to the end of the specification for access instructions.

Lengthy table referenced here
US10124055-20181113-T00049

Please refer to the end of the specification for access instructions.

Lengthy table referenced here
US10124055-20181113-T00050

Please refer to the end of the specification for access instructions.

Lengthy table referenced here
US10124055-20181113-T00051

Please refer to the end of the specification for access instructions.

Lengthy table referenced here
US10124055-20181113-T00052

Please refer to the end of the specification for access instructions.

Lengthy table referenced here
US10124055-20181113-T00053

Please refer to the end of the specification for access instructions.

Lengthy table referenced here
US10124055-20181113-T00054

Please refer to the end of the specification for access instructions.

Lengthy table referenced here
US10124055-20181113-T00055

Please refer to the end of the specification for access instructions.

Lengthy table referenced here
US10124055-20181113-T00056

Please refer to the end of the specification for access instructions.

Lengthy table referenced here
US10124055-20181113-T00057

Please refer to the end of the specification for access instructions.

Lengthy table referenced here
US10124055-20181113-T00058

Please refer to the end of the specification for access instructions.

Lengthy table referenced here
US10124055-20181113-T00059

Please refer to the end of the specification for access instructions.

Lengthy table referenced here
US10124055-20181113-T00060

Please refer to the end of the specification for access instructions.

Lengthy table referenced here

US10124055-20181113-T00061

Please refer to the end of the specification for access instructions.

Lengthy table referenced here

US10124055-20181113-T00062

Please refer to the end of the specification for access instructions.

Lengthy table referenced here

US10124055-20181113-T00063

Please refer to the end of the specification for access instructions.

Lengthy table referenced here

US10124055-20181113-T00064

Please refer to the end of the specification for access instructions.

Lengthy table referenced here

US10124055-20181113-T00065

Please refer to the end of the specification for access instructions.

Lengthy table referenced here

US10124055-20181113-T00066

Please refer to the end of the specification for access instructions.

Lengthy table referenced here

US10124055-20181113-T00067

Please refer to the end of the specification for access instructions.

EQUIVALENTS

Those skilled in the art will recognize, or be able to ascertain using no more than routine experimentation, many equivalents to the specific embodiments of the disclosure described herein. Such equivalents are intended to be encompassed by the following claims.

All references, including patent documents, disclosed herein are incorporated by reference in their entirety.

LENGTHY TABLES

The patent contains a lengthy table section. A copy of the table is available in electronic form from the USPTO web site (http://seqdata.uspto.gov/?pageRequest=docDetail&DocID=US10124055B2). An electronic copy of the table will also be available from the USPTO upon request and payment of the fee set forth in 37 CFR 1.19(b)(3).

SEQUENCE LISTING (469 sequences)

SEQ ID NO: 1 - DNA, 1215 bp, Plasmodium falciparum
atgatgagaaaattagctattttatctgtttcttcctttttatttgttgaggccttattccaggaataccagtgctatggaagttcgtcaaacacaagggttctaaatgaattaaattatgataatgcaggcactaatttatataatgaattagaaatgaattattatgggaaacaggaaaattggtatagtcttaaaaaaaatagtagatcacttggagaaaatgatgatggaaataacgaagacaacgagaaattaaggaaaccaaaacataaaaaattaaagcaaccagcggatggtaatcctgatccaaatgcaaacccaaatgtagatcccaatgccaacccaaatgtagatccaaatgcaaacccaaatgtagatccaaatgcaaacccaaatgcaaacccaaatgcaaacccaaatgcaaacccaaatgcaaacccaaatgcaaacccaaatgcaaacccaaatgcaaacccaaatgcaaacccaaatgcaaacccaaatgcaaacccaaatgcaaacccaaatgcaaacccaaatgcaaacccaaatgcaaacccaaatgcaaaccccaatgcaaatcctaatgcaaacccaaatgcaaacccaaacgtagatcctaatgcaaatccaaatgcaaacccaaacgcaaaccccaatgcaaatcctaatgcaaaccccaatgcaaatcctaatgcaaatcctaatgccaatccaaatgcaaatccaaatgcaaacccaaacgcaaaccccaatgcaaatcctaatgccaatccaaatgcaaatccaaatgcaaacccaaatgcaaacccaaatgcaaaccccaatgcaaatcctaataaaaacaatcaaggtaatggacaaggtcacaatatgccaaatgacccaaaccgaaatgtagatgaaaatgctaatgccaacagtgctgtaaaaaataataataacgaagaaccaagtgataagcacataaaagaatatttaaacaaaatacaaaattctctttcaactgaatggtccccatgtagtgtaacttgtggaaatggtattcaagttagaataaagcctggctctgctaataaacctaaagacgaattagattatgcaaatgatattgaaaaaaaaatttgtaaaatggaaaaatgttccagtgtgtttaatgtcgtaaatagttcaataggattaataatggtattatccttcttgttccttaat

SEQ ID NO: 2 - DNA, 1230 bp, Plasmodium falciparum
atgtggtggcgcctgtggtggctgctgctgctgctgctgctgctgtggcccatggtgtgggccgaggccttattccaggaataccagtgctatggaagttcgtcaaacacaagggttctaaatgaattaaattatgataatgcaggcactaatttatataatgaattagaaatgaattattatgggaaacaggaaaattggtatagtcttaaaaaaaatagtagatcacttggagaaaatgatgatggaaataacgaagacaacgagaaattaaggaaaccaaaacataaaaaattaaagcaaccagcggatggtaatcctgatccaaatgcaaacccaaatgtagatcccaatgccaacccaaatgtagatccaaatgcaaacccaaatgtagatccaaatgcaaacccaaatgcaaacccaaatgcaaacccaaatgcaaacccaaatgcaaacccaaatgcaaacccaaatgcaaacccaaatgcaaacccaaatgcaaacccaaatgcaaacccaaatgcaaacccaaatgcaaacccaaatgcaaacccaaatgcaaacccaaatgcaaacccaaatgcaaaccccaatgcaaatcctaatgcaaacccaaatgcaaacccaaacgtagatcctaatgcaaatccaaatgcaaacccaaacgcaaaccccaatgcaaatcctaatgcaaaccccaatgcaaatcctaatgcaaatcctaatgccaatccaaatgcaaatccaaatgcaaacccaaacgcaaaccccaatgcaaatcctaatgccaatccaaatgcaaatccaaatgcaaacccaaatgcaaacccaaatgcaaaccccaatgcaaatcctaataaaaacaatcaaggtaatggacaaggtcacaatatgccaaatgacccaaaccgaaatgtagatgaaaatgctaatgccaacagtgctgtaaaaaataataataacgaagaaccaagtgataagcacataaaagaatatttaaacaaaatacaaaattctctttcaactgaatggtccccatgtagtgtaacttgtggaaatggtattcaagttagaataaagcctggctctgctaataaacctaaagacgaattagattatgcaaatgatattgaaaaaaaaatttgtaaaatggaaaaatgttccagtgtgtttaatgtcgtaaatagttcaataggattaataatggtattatccttcttgttccttaat

SEQ ID NO: 3 - DNA, 3486 bp, Plasmodium falciparum
atgaaacatattttgtacatatcattttactttatccttgttaatttattgatatttcatataaatggaaagataataaagaattctgaaaaagatgaaatcataaaatctaacttgagaagtggttcttcaaattctaggaatcgaataaatgaggaaaagcacgagaagaaacacgttttatctcataattcatatgagaaaactaaaaataatgaaaataataaatttttcgataaggataaagagttaacgatgtctaatgtaaaaaatgtgtcacaaacaaatttcaaaagtcttttaagaaatcttggtgtttcagagaatatattccttaaagaaaataaattaaataaggaagggaaattaattgaacacataataaatgatgatgacgataaaaaaaaatatattaaagggcaagacgaaaacagacaagaagatcttgaacaagagagacttgctaaagaaaagttacaggggcaacaaagcgatttagaacaagagagacttgctaaagaaaagttgcaagaacaacaaagcgatttagaacaagagagacttgctaaagaaaagttgcaagaacaacaaagcgatttagaacaagatagacttgctaaagaaaagttacaagagcaacaaagcgatttagaacaagagagacgtgctaaagaaaagttgcaagaacaacaaagcgatttagaacgaacgaagacttctaaagaaaagttacatgagcagcaaagcgatttagaacaagagagacgtgctaaagaaaagttgcaagaacaacaaagcgatttagaacaagagagacttgctaaagaaaagttgcaagagcaacaaagcgatttagaacaagagagacttgctaaagaaaagttgcaagaacaacaaagcgatttagaacaagagagacttgctaaagaaaagttacaagagcagcaaagcgatttagaacaagagagacttgctaaagaaaagttgcaagaacaacaaagcgatttagaacaagagagacttgctaaagaaaagttgcaagaacaacaaagcgatttagaacaagatagacttgctaaagaaaagttacaagagcaacaaagcgatttagaacaagagagacttgctaaagaaaagttgcaagaacaacaaagcgatttagaacaagagagacgtgctaaagaaaagttgcaagaacaacaaagcgatttagaacaagagagacgtgctaaagaaaagttgcaagaacaacaaagcgatttagaacaagagagacgtgctaaagaaaagttgcaagaacaacaaagcgatttagaacaagagagacgtgctaaagaaaagttgcaagaacaacaaagcgatttagaacaagagagacttgctaaagaaaagttgcaagaacaacaaagcgatttagaacaagagagacgtgctaaagaaaagttgcaagaacaacaaagcgatttagaacaagagagacttgctaaagaaaagttgcaagaacaacaaagcgatttagaacaagagagacgtgctaaagaaaagttgcaagaacaacaaagcgatttagaacaagagagacgtgctaaagaaaagttgcaagaacaacaaagcgatttagaacaagatagacttgctaaagaaaagttacaagagcaacaaagcgatttagaacaagagagacgtgctaaagaaaagttgcaagaacaacaaagcgatttagaacgaacgaaggcatctacagaaacgttgcatgagcagcaaagcgatcttgaacaagagagacttgctaaagaaaagttacaagagcagcaaagcgatttagaacaagagagacttgctaaagaaaagttacaagagcaacaaagcgatttagaacgaacgaaggcatctacagaaacgttgcgtgagcagcaaagcgatcttgaacaagagaaactagctaaagaaaagttacaggggcaacaaagcgatcttgaacaagagagactagctaaagaaaagttacaggggcaacaaagcgatcttgaacaagagagactagctaaagaaaagttacaggggcaacaaagcgatcttgaacaagagagactagctaaagaaaagttacaggggcaacaaagcgatttagaacaagagagacttgctaaagaaaagttgcaagagcgacaaagcgatttagaacaagagagacttgctaaagaaaagttgcaagaacaacaaagcgatttagaacaagagagactagctaaagaaaagttgcaagaacaacaaagcgatttagaacaagacagacttgctaaagaaaagttgcaagaacaacaaagcgatttagaacaagagagactagctaaggaaaagttacaggggcagcatagcgatttagaacgaacgaaggcatctaaagaaacgttgcaagaacaacaaagcgatttagaacaagagagacttgctaaagaaaagttgcaagaacaacaaagcgatttagaacaagagagacgtgctaaagaaaagttgcaagaacaacaaagcgatttagaacaagagagacgtgctaaagaaaagttgcaagaacaacaaagcgatttagaacaagagagacgtgctaaagaaaagttgcaagagcagcaaagagatttagaacaaaggaaggctgatacgaaaaaaaatttagaaagaaaaaaggaacatggagatgtattagcagaggatttatatggtcgtttagaaataccagctatagaacttccatcagaaaatgaacgtggatattatataccacatcaatcttctttacctcaggacaacagagggaatagtagagattcgaaggaaatatctataatagaaaatacaaatagagaatctattacaacaaatgttgaaggacgaagggatatacataaaggacatcttgaagaaaagaaagatggttcaataaaaccagaacaaaaagaagataaatctgctgacatacaaaatcatacattagagacagtaaatatttctgatgttaatgattttcaaataagtaagtatgaggatgaaataagtgctgaatatgacgattcattaatagatgaagaagaagatgatgaagacttagacgaatttaagcctattgtgcaatatgacaatttccaagatgaagaaaacataggaatttataaagaactagaagatttgatagagaaaaatgaaaatttagatgatttagatgaaggaatagaaaaatcatcagaagaattatctgaagaaaaaataaaaaaaggaaagaaatatgaaaaaacaaaggataataattttaaaccaaatgataaaagtttgtatgatgagcatattaaaaaatataaaaatgataagcaggttaataaggaaaaggaaaaattcataaaatcattgtttcatatatttgacggagacaatgaaattttacagatcgtggatgagttatctgaagatataactaaatattttatgaaacta

SEQ ID NO: 4 - DNA, 5160 bp, Plasmodium falciparum
atgaagatcatattctttttatgttcatttcttttttttattataaatacacaatgtgtaacacatgaaagttatcaagaacttgtcaaaaaactagaagctttagaagatgcagtattgacaggttatagtttatttcaaaaggaaaaaatggtattaaatgaagaagaaattactacaaaaggtgcaagtgctcaaagtggtgcaagtgctcaaagtggtgcaagtgctcaaagtggtgcaagtgctcaaagtggtgcaagtgctcaaagtggtgcaagtgctcaaagtggtacaagtggtccaagtggtccaagtggtacaagtccatcatctcgttcaaacactttacctcgttcaaatacttcatctggtgcaagccctccagctgatgcaagcgattcagatgctaaatcttacgctgatttaaaacacagagtacgaaattacttgttcactattaaagaactcaaatatcccgaactctttgatttaaccaatcatatgttaactttgtgtgataatattcatggtttcaaatatttaattgatggatatgaagaaattaatgaattattatataaattaaacttttattttgatttattaagagcaaaattaaatgatgtatgtgctaatgattattgtcaaatacctttcaatcttaaaattcgtgcaaatgaattagacgtacttaaaaaacttgtgttcggatatagaaaaccattagacaatattaaagataatgtaggaaaaatggaagattacattaaaaaaaataaaacaaccatagcaaatataaatgaattaattgaaggaagtaagaaaacaattgatcaaaataagaatgcagataatgaagaagggaaaaaaaaattataccaagctcaatatgatctttctatttacaataaacaattagaagaagcacataatttaataagcgttttagaaaaacgtattgacactttaaaaaaaaatgaaaacataaagaaattacttgataagataaatgaaattaaaaatcccccaccggccaattctggaaatacaccaaatactctccttgataagaacaaaaaaatcgaggaacacgaagaaaaaataaaagaaattgccaaaactattaaatttaacattgatagtttatttactgatccacttgaattagaatattatttaagagaaaaaaataaaaaagttgatgtaacacctaaatcacaagatcctacgaaatctgttcaaataccaaaagttccttatccaaatggtattgtatatcctttaccactcactgatattcataattcattagctgcagataatgataaaaattcatatggtgatttaatgaatcctcatactaaagaaaaaattaatgaaaaaattattacagataataaggaaagaaaaatattcattaataacattaaaaaaaaaattgatttagaagaaaaaaacattaatcacacaaaagaacaaaataaaaaattacttgaagattatgaaaagtcaaaaaaggattatgaagaattacttgaaaaattttatgaaatgaaatttaataataattttaacaaagatgtcgtagataaaatattcagtgcaagatatacatataatgttgaaaaacaaagatataataataaattttcatcctctaataattctgtatataatgttcaaaaattaaaaaaggctctttcatatcttgaagattattctttaagaaaaggaatttctgaaaaagattttaatcattattatactttgaaaactggcctcgaagctgatataaaaaaattaacagaagaaataaagagtagtgaaaacaaaattcttgaaaaaaattttaaaggactaacacattcagcaaatggttccttagaagtatctgatattgtaaaattacaagtacaaaaagttttattaattaaaaaaatagaagacttaagaaagatagaattatttttaaaaaatgcacaactaaaagatagtattcatgtaccaaatatttataaaccacaaaataaaccagaaccatattatttaattgtattaaaaaaagaagtagataaattaaaagaatttataccaaaagtaaaagacatgttaaagaaagaacaagctgtcttatcaagtattacacaacctttagttgcagcaagcgaaacaactgaagatgggggtcactccacacacacattatcccaatcaggagaaacagaagtaacagaagaaacagaagaaacagaagaaacagtaggacacacaacaacggtaacaataacattaccaccaacacaaccatcaccaccaaaagaagtaaaagttgttgaaaattcaatagaacataagagtaatgacaattcacaagccttgacaaaaacagtttatctaaagaaattagatgaatttttaactaaatcatatatatgtcataaatatattttagtatcaaactctagtatggaccaaaaattattagaggtatataatcttactccagaagaagaaaatgaattaaaatcatgtgatccattagatttattatttaatattcaaaataacatacctgctatgtattcattatatgatagtatgaacaatgatttacaacatctcttttttgaattatatcaaaaggaaatgatttattatttacataaactaaaagaggaaaatcacatcaaaaaattattagaggagcaaaaacaaataactggaacatcatctacatccagtcctggaaatacaaccgtaaatactgctcaatccgcaactcacagtaattcccaaaaccaacaatcaaatgcatcctctaccaatacccaaaatggtgtagctgtatcatctggtcctgctgtagttgaagaaagtcatgatcccttaacagtattgtctattagtaacgatttgaaaggtattgttagtctcttaaatcttggaaataaaactaaagtacctaatccattaaccatttctacaacagagatggaaaaattttatgagaatattttaaaaaataatgatacctattttaatgatgatatcaaacaattcgtaaaatctaattcaaaagtaattacaggtttgaccgaaacacaaaaaaatgcattaaatgatgaaattaaaaaattaaaagatactttacagttatcatttgatttatataataaatataaattaaaattagatagattatttaataagaaaaaagaacttggccaagacaaaatgcaaattaaaaaacttactttattaaaagaacaattagaatcaaaattgaattcacttaataacccacataatgtattacaaaacttttctgttttctttaacaaaaaaaaagaagctgaaatagcagaaactgaaaacacattagaaaacacaaaaatattattgaaacattataaaggacttgttaaatattataatggtgaatcatctccattaaaaactttaagtgaagtatcaattcaaacagaagataattatgccaatttagaaaaatttagagtattaagtaaaatagatggaaaactcaatgataatttacatttaggaaagaaaaaattatctttcttatcaagtggattacatcatttaattactgaattaaaagaagtaataaaaaataaaaattatacaggtaattctccaagtgaaaataataagaaagttaacgaagctttaaaatcttacgaaaattttctcccagaagcaaaagttacaacagttgtaactccacctcaaccagatgtaactccatctccattatctgtaagggtaagtggtagttcaggatccacaaaagaagaaacacaaataccaacttcaggctctttattaacagaattacaacaagtagtacaattacaaaattatgacgaagaagatgattccttagttgtattacccatttttggagaatccgaagataatgacgaatatttagatcaagtagtaactggagaagcaatatctgtcacaatggataatatcctctcaggatttgaaaatgaatatgatgttatatatttaaaacctttagctggagtatatagaagcttaaaaaaacaaattgaaaaaaacatttttacatttaatttaaatttgaacgatatcttaaattcacgtcttaagaaacgaaaatatttcttagatgtattagaatctgatttaatgcaatttaaacatatatcctcaaatgaatacattattgaagattcatttaaattattgaattcagaacaaaaaaacacacttttaaaaagttacaaatatataaaagaatcagtagaaaatgatattaaatttgcacaggaaggtataagttattatgaaaaggttttagcgaaatataaggatgatttagaatcaattaaaaaagttatcaaagaagaaaaggagaagttcccatcatcaccaccaacaacacctccgtcaccagcaaaaacagacgaacaaaagaaggaaagtaagttccttccatttttaacaaacattgagaccttatacaataacttagttaataaaattgacgattacttaattaacttaaaggcaaagattaacgattgtaatgttgaaaaagatgaagcacatgttaaaataactaaacttagtgatttaaaagcaattgatgacaaaatagatctttttaaaaacccttacgacttcgaagcaattaaaaaattgataaatgatgatacgaaaaaagatatgcttggcaaattacttagtacaggattagttcaaaattttcctaatacaataatatcaaaattaattgaaggaaaattccaagatatgttaaacatttcacaacaccaatgcgtaaaaaaacaatgtccagaaaattctggatgtttcagacatttagatgaaagagaagaatgtaaatgtttattaaattacaaacaagaaggtgataaatgtgttgaaaatccaaatcctacttgtaacgaaaataatggtggatgtgatgcagatgccacatgtaccgaagaagattcaggtagcagcagaaagaaaatcacatgtgaatgtactaaacctgattcttatccacttttcgatggtattttctgcagttcctctaacttcttaggaatatcattcttattaatactcatgttaatattatacagtttcatt

SEQ ID NO: 5 - DNA, 1866 bp, Plasmodium falciparum
atgagaaaattatactgcgtattattattgagcgcctttgagtttacatatatgataaactttggaagaggacagaattattgggaacatccatatcaaaatagtgatgtgtatcgtccaatcaacgaacatagggaacatccaaaagaatacgaatatccattacaccaggaacatacataccaacaagaagattcaggagaagacgaaaatacattacaacacgcatatccaatagaccacgaaggtgctgaacccgcaccacaagaacaaaacttattctcaagcattgaaatagtcgaacggtcgaattatatgggtaatccgtggacggaatacatggcaaaatatgatattgaagaagttcatggttcaggtataagggtagatttaggagaggatgctgaagtagctggaactcaatacagacttccatcaggtaaatgtccagtattcggtaaaggtataattattgagaattcaaatactacttttctaacaccggtagctacaggaaatcaatatctaaaagatggagggtttgcgtttcctccaacagaacctcttatgtcaccaatgacactagatgaaatgagacatttttataaggataataaatacgtaaaaaacctcgacgaattgactttatgttcaagacatgcagggaatatgattccagataatgataaaaactcaaattataaatacccggctgtttatgatgataaagataaaaagtgtcatatcctgtatattgcagctcaagaaaataatggtcctagatattgtaataaagacgaaagtaaaagaaacagcatgttttgtttcagaccagcaaaagacataagcttccaaaactatacttacttgtctaaaaatgtagttgataactgggaaaaagtctgccctagaaagaatttacagaatgcgaaattcggactatgggtcgatggtaactgtgaagatataccacatgtaaatgaatttccagcaatagatcttttcgaatgcaataaactggtttttgaattgagtgcctcggatcagccaaaacagtatgaacaacatttaacagattacgaaaaaatcaaagaaggttttaaaaataaaaatgctagtatgatcaagagtgcttttcttcccacgggtgcttttaaggcagatcgttataaaagtcacggtaaaggatataattggggtaactataacacagagacacaaaagtgtgaaatttttaatgttaaaccaacatgtctcataaacaattcctcatacattgctaccactgctttatcccatcccatcgaagtagagaacaattttccttgtagcctatacaaagatgaaataatgaaagaaatcgagagagaatcaaaacgaattaaattaaatgataacgatgacgaggggaacaaaaaaattatagctccacgcatttttatttcagacgataaagactcgttaaaatgcccatgtgaccctgaaatggtcagtaacagtacatgccgcttctttgtatgtaaatgtgtagaaaggagggcagaagtaacatcaaataacgaggttgtagtaaaagaagaatacaaagatgagtacgcagatattcccgaacacaaaccaacctatgataagatgaaaataataatagcatcatcagctgcagttgctgtactagcgacgattttaatggtttatctttataaaagaaagggaaatgctgaaaaatatgataaaatggatgaaccgcaagattatgggaaatccaattcacgaaacgatgagatgcttgatcctgaggcatctttctggggggaagaaaaaagagcatcacatacaacaccagtactgatggaaaaaccatactat

SEQ ID NO: 6 - DNA, 1725 bp, Plasmodium falciparum
atgaatcatcttgggaatgttaaatatttagtcattgtgtttttgattttctttgatttgtttctagttaatggtagagatgtgcaaaacaatatagtggatgaaataaaatatcgtgaagaagtatgtaatgatgaggtagatctttaccttctaatggattgttctggaagtatacgtcgtcataattgggtgaaccatgcagtacctctagctatgaaattgatacaacaattaaatcttaatgataatgcaattcacttatatgctagtgttttttcaaacaatgcaagagaaattattagattacatagtgatgcatctaaaaacaaagagaaggctttaattattataaagtcactcttaagtacaaatcttccatatggtaaaacaaacttaactgatgcactgttacaagtaagaaaacatttaaatgaccgaatcaatagagagaatgctaatcaattagttgttatattaacagatggaattccagatagtattcaagattcattaaaagaatcaagaaaattaagtgatcgtggtgttaaaatagctgtttttggtattggacaaggtattaatgtagctttcaacagatttcttgtaggttgtcatccatcagatggtaaatgtaacttgtatgctgattctgcatgggaaaatgtaaaaaatgttatcggaccctttatgaaggctgtttgtgttgaagtagaaaaaacagcaagttgtggtgtttgggacgaatggtctccatgtagtgtaacttgtggtaaaggtaccaggtcaagaaaaagagaaatcttacacgaaggatgtacaagtgaattacaagaacaatgtgaagaagaaagatgtcttccaaaacgggaaccattagatgttccagatgaacccgaagatgatcaacctagaccaagaggagataattttgctgtcgaaaaaccaaacgaaaatataatagataataatccacaagaaccttcaccaaatccagaagaaggaaagggtgaaaatccaaacggatttgatttagatgaaaatccagaaaatccaccaaatccaccaaatccaccaaatccaccaaatccaccaaatccaccaaatccagatattcctgaacaagaaccaaatatacctgaagattcagaaaaagaagtaccttctgatgttccaaaaaatccagaagacgatcgagaagaaaactttgatattccaaagaaacccgaaaataagcacgataatcaaaataatttaccaaatgataaaagtgatagatatattccatattcaccattatctccaaaagttttggataatgaaaggaaacaaagtgacccccaaagtcaagataataatggaaataggcacgtacctaatagtgaagatagagaaacacgtccacatggtagaaataatgaaaatagatcatacaatagaaaacataacaatactccaaaacatcctgaaagggaagaacatgaaaagccagataataataaaaaaaaagcaggatcagataataaatataaaattgcaggtggaatagctggaggattagctttactcgcatgtgctggacttgcttataaattcgtagtaccaggagcagcaacaccctatgccggagaacctgcaccttttgatgaaacattaggtgaagaagataaagatttggacgaacctgaacaattcagattacctgaagaaaacgagtggaattaa

SEQ ID NO: 7 - RNA, 1215 nt, Plasmodium falciparum
augaugagaaaauuagcuauuuuaucuguuucuuccuuuuuauuuguugaggccuuauuccaggaauaccagugcuauggaaguucgucaaacacaaggguucuaaaugaauuaaauuaugauaaugcaggcacuaauuuauauaaugaauuagaaaugaauuauuaugggaaacaggaaaauugguauagucuuaaaaaaaauaguagaucacuuggagaaaaugaugauggaaauaacgaagacaacgagaaauuaaggaaaccaaaacauaaaaaauuaaagcaaccagcggaugguaauccugauccaaaugcaaacccaaauguagaucccaaugccaacccaaauguagauccaaaugcaaacccaaauguagauccaaaugcaaacccaaaugcaaacccaaaugcaaacccaaaugcaaacccaaaugcaaacccaaaugcaaacccaaaugcaaacccaaaugcaaacccaaaugcaaacccaaaugcaaacccaaaugcaaacccaaaugcaaacccaaaugcaaacccaaaugcaaacccaaaugcaaacccaaaugcaaaccccaaugcaaauccuaaugcaaacccaaaugcaaacccaaacguagauccuaaugcaaauccaaaugcaaacccaaacgcaaaccccaaugcaaauccuaaugcaaaccccaaugcaaauccuaaugcaaauccuaaugccaauccaaaugcaaauccaaaugcaaacccaaacgcaaaccccaaugcaaauccuaaugccaauccaaaugcaaauccaaaugcaaacccaaaugcaaacccaaaugcaaaccccaaugcaaauccuaauaaaaacaaucaagguaauggacaaggucacaauaugccaaaugacccaaaccgaaauguagaugaaaaugcuaaugccaacagugcuguaaaaaauaauaauaacgaagaaccaagugauaagcacauaaaagaauauuuaaacaaaauacaaaauucucuuucaacugaaugguccccauguaguguaacuuguggaaaugguauucaaguuagaauaaagccuggcucugcuaauaaaccuaaagacgaauuagauuaugcaaaugauauugaaaaaaaaauuuguaaaauggaaaaauguuccaguguguuuaaugucguaaauaguucaauaggauuaauaaugguauuauccuucuuguuccuuaau

SEQ ID NO: 8 - RNA, 1230 nt, Plasmodium falciparum
augugguggcgccugugguggcugcugcugcugcugcugcugcuguggcccauggugugggccgaggccuuauuccaggaauaccagugcuauggaaguucgucaaacacaaggguucuaaaugaauuaaauuaugauaaugcaggcacuaauuuauauaaugaauuagaaaugaauuauuaugggaaacaggaaaauugguauagucuuaaaaaaaauaguagaucacuuggagaaaaugaugauggaaauaacgaagacaacgagaaauuaaggaaaccaaaacauaaaaaauuaaagcaaccagcggaugguaauccugauccaaaugcaaacccaaauguagaucccaaugccaacccaaauguagauccaaaugcaaacccaaauguagauccaaaugcaaacccaaaugcaaacccaaaugcaaacccaaaugcaaacccaaaugcaaacccaaaugcaaacccaaaugcaaacccaaaugcaaacccaaaugcaaacccaaaugcaaacccaaaugcaaacccaaaugcaaacccaaaugcaaacccaaaugcaaacccaaaugcaaacccaaaugcaaaccccaaugcaaauccuaaugcaaacccaaaugcaaacccaaacguagauccuaaugcaaauccaaaugcaaacccaaacgcaaaccccaaugcaaauccuaaugcaaaccccaaugcaaauccuaaugcaaauccuaaugccaauccaaaugcaaauccaaaugcaaacccaaacgcaaaccccaaugcaaauccuaaugccaauccaaaugcaaauccaaaugcaaacccaaaugcaaacccaaaugcaaaccccaaugcaaauccuaauaaaaacaaucaagguaauggacaaggucacaauaugccaaaugacccaaaccgaaauguagaugaaaaugcuaaugccaacagugcuguaaaaaauaauaauaacgaagaaccaagugauaagcacauaaaagaauauuuaaacaaaauacaaaauucucuuucaacugaaugguccccauguaguguaacuuguggaaaugguauucaaguuagaauaaagccuggcucugcuaauaaaccuaaagacgaauuagauuaugcaaaugauauugaaaaaaaaauuuguaaaauggaaaaauguuccaguguguuuaaugucguaaauaguucaauaggauuaauaaugguauuauccuucuuguuccuuaau

SEQ ID NO: 9 - RNA, 3486 nt, Plasmodium falciparum
augaaacauauuuuguacauaucauuuuacuuuauccuuguuaauuuauugauauuucauauaaauggaaagauaauaaagaauucugaaaaagaugaaaucauaaaaucuaacuugagaagugguucuucaaauucuaggaaucgaauaaaugaggaaaagcacgagaagaaacacguuuuaucucauaauucauaugagaaaacuaaaaauaaugaaaauaauaaauuuuucgauaaggauaaagaguuaacgaugucuaauguaaaaaaugugucacaaacaaauuucaaaagucuuuuaagaaaucuugguguuucagagaauauauuccuuaaagaaaauaaauuaaauaaggaagggaaauuaauugaacacauaauaaaugaugaugacgauaaaaaaaaauauauuaaagggcaagacgaaaacagacaagaagaucuugaacaagagagacuugcuaaagaaaaguuacaggggcaacaaagcgauuuagaacaagagagacuugcuaaagaaaaguugcaagaacaacaaagcgauuuagaacaagagagacuugcuaaagaaaaguugcaagaacaacaaagcgauuuagaacaagauagacuugcuaaagaaaaguuacaagagcaacaaagcgauuuagaacaagagagacgugcuaaagaaaaguugcaagaacaacaaagcgauuuagaacgaacgaagacuucuaaagaaaaguuacaugagcagcaaagcgauuuagaacaagagagacgugcuaaagaaaaguugcaagaacaacaaagcgauuuagaacaagagagacuugcuaaagaaaaguugcaagagcaacaaagcgauuuagaacaagagagacuugcuaaagaaaaguugcaagaacaacaaagcgauuuagaacaagagagacuugcuaaagaaaaguuacaagagcagcaaagcgauuuagaacaagagagacuugcuaaagaaaaguugcaagaacaacaaagcgauuuagaacaagagagacuugcuaaagaaaaguugcaagaacaacaaagcgauuuagaacaagauagacuugcuaaagaaaaguuacaagagcaacaaagcgauuuagaacaagagagacuugcuaaagaaaaguugcaagaacaacaaagcgauuuagaacaagagagacgugcuaaagaaaaguugcaagaacaacaaagcgauuuagaacaagagagacgugcuaaagaaaaguugcaagaacaacaaagcgauuuagaacaagagagacgugcuaaagaaaaguugcaagaacaacaaagcgauuuagaacaagagagacgugcuaaagaaaaguugcaagaacaacaaagcgauuuagaacaagagagacuugcuaaagaaaaguugcaagaacaacaaagcgauuuagaacaagagagacgugcuaaagaaaaguugcaagaacaacaaagcgauuuagaacaagagagacuugcuaaagaaaaguugcaagaacaacaaagcgauuuagaacaagagagacgugcuaaagaaaaguugcaagaacaacaaagcgauuuagaacaagagagacgugcuaaagaaaaguugcaagaacaacaaagcgauuuagaacaagauagacuugcuaaagaaaaguuacaagagcaacaaagcgauuuagaacaagagagacgugcuaaagaaaaguugcaagaacaacaaagcgauuuagaacgaacgaaggcaucuacagaaacguugcaugagcagcaaagcgaucuugaacaagagagacuugcuaaagaaaaguuacaagagcagcaaagcgauuuagaacaagagagacuugcuaaagaaaaguuacaagagcaacaaagcgauuuagaacgaacgaaggcaucuacagaaacguugcgugagcagcaaagcgaucuugaacaagagaaacuagcuaaagaaaaguuacaggggcaacaaagcgaucuugaacaagagagacuagcuaaagaaaaguuacaggggcaacaaagcgaucuugaacaagagagacuagcuaaagaaaaguuacaggggcaacaaagcgaucuugaacaagagagacuagcuaaagaaaaguuacaggggcaacaaagcgauuuagaacaagagagacuugcuaaagaaaaguugcaagagcgacaaagcgauuuagaacaagagagacuugcuaaagaaaaguugcaagaacaacaaagcgauuuagaacaagagagacuagcuaaagaaaaguugcaagaacaacaaagcgauuuagaacaagacagacuugcuaaagaaaaguugcaagaacaacaaagcgauuuagaacaagagagacuagcuaaggaaaaguuacaggggcagcauagcgauuuagaacgaacgaaggcaucuaaagaaacguugcaagaacaacaaagcgauuuagaacaagagagacuugcuaaagaaaaguugcaagaacaacaaagcgauuuagaacaagagagacgugcuaaagaaaaguugcaagaacaacaaagcgauuuagaacaagagagacgugcuaaagaaaaguugcaagaacaacaaagcgauuuagaacaagagagacgugcuaaagaaaaguugcaagagcagcaaagagauuuagaacaaaggaaggcugauacgaaaaaaaauuuagaaagaaaaaaggaacauggagauguauuagcagaggauuuauauggucguuuagaaauaccagcuauagaacuuccaucagaaaaugaacguggauauuauauaccacaucaaucuucuuuaccucaggacaacagagggaauaguagagauucgaaggaaauaucuauaauagaaaauacaaauagagaaucuauuacaacaaauguugaaggacgaagggauauacauaaaggacaucuugaagaaaagaaagaugguucaauaaaaccagaacaaaaagaagauaaaucugcugacauacaaaaucauacauuagagacaguaaauauuucugauguuaaugauuuucaaauaaguaaguaugaggaugaaauaagugcugaauaugacgauucauuaauagaugaagaagaagaugaugaagacuuagacgaauuuaagccuauugugcaauaugacaauuuccaagaugaagaaaacauaggaauuuauaaagaacuagaagauuugauagagaaaaaugaaaauuuagaugauuuagaugaaggaauagaaaaaucaucagaagaauuaucugaagaaaaaauaaaaaaaggaaagaaauaugaaaaaacaaaggauaauaauuuuaaaccaaaugauaaaaguuuguaugaugagcauauuaaaaaauauaaaaaugauaagcagguuaauaaggaaaaggaaaaauucauaaaaucauuguuucauauauuugacggagacaaugaaauuuuacagaucguggaugaguuaucugaagauauaacuaaauauuuuaugaaacua

SEQ ID NO: 10 - RNA, 5160 nt, Plasmodium falciparum
augaagaucauauucuuuuuauguucauuucuuuuuuuuauuauaaauacacaauguguaacacaugaaaguuaucaagaacuugucaaaaaacuagaagcuuuagaagaugcaguauugacagguuauaguuuauuucaaaaggaaaaaaugguauuaaaugaagaagaaauuacuacaaaaggugcaagugcucaaaguggugcaagugcucaaaguggugcaagugcucaaaguggugcaagugcucaaaguggugcaagugcucaaaguggugcaagugcucaaagugguacaagugguccaagugguccaagugguacaaguccaucaucucguucaaacacuuuaccucguucaaauacuucaucuggugcaagcccuccagcugaugcaagcgauucagaugcuaaaucuuacgcugauuuaaaacacagaguacgaaauuacuuguucacuauuaaagaacucaaauaucccgaacucuuugauuuaaccaaucauauguuaacuuugugugauaauauucaugguuucaaauauuuaauugauggauaugaagaaauuaaugaauuauuauauaaauuaaacuuuuauuuugauuuauuaagagcaaaauuaaaugauguaugugcuaaugauuauugucaaauaccuuucaaucuuaaaauucgugcaaaugaauuagacguacuuaaaaaacuuguguucggauauagaaaaccauuagacaauauuaaagauaauguaggaaaaauggaagauuacauuaaaaaaaauaaaacaaccauagcaaauauaaaugaauuaauugaaggaaguaagaaaacaauugaucaaaauaagaaugcagauaaugaagaagggaaaaaaaaauuauaccaagcucaauaugaucuuucuauuuacaauaaacaauuagaagaagcacauaauuuaauaagcguuuuagaaaaacguauugacacuuuaaaaaaaaaugaaaacauaaagaaauuacuugauaagauaaaugaaauuaaaaaucccccaccggccaauucuggaaauacaccaaauacucuccuugauaagaacaaaaaaaucgaggaacacgaagaaaaaauaaaagaaauugccaaaacuauuaaauuuaacauugauaguuuauuuacugauccacuugaauuagaauauuauuuaagagaaaaaaauaaaaaaguugauguaacaccuaaaucacaagauccuacgaaaucuguucaaauaccaaaaguuccuuauccaaaugguauuguauauccuuuaccacucacugauauucauaauucauuagcugcagauaaugauaaaaauucauauggugauuuaaugaauccucauacuaaagaaaaaauuaaugaaaaaauuauuacagauaauaaggaaagaaaaauauucauuaauaacauuaaaaaaaaaauugauuuagaagaaaaaaacauuaaucacacaaaagaacaaaauaaaaaauuacuugaagauuaugaaaagucaaaaaaggauuaugaagaauuacuugaaaaauuuuaugaaaugaaauuuaauaauaauuuuaacaaagaugucguagauaaaauauucagugcaagauauacauauaauguugaaaaacaaagauauaauaauaaauuuucauccucuaauaauucuguauauaauguucaaaaauuaaaaaaggcucuuucauaucuugaagauuauucuuuaagaaaaggaauuucugaaaaagauuuuaaucauuauuauacuuugaaaacuggccucgaagcugauauaaaaaaauuaacagaagaaauaaagaguagugaaaacaaaauucuugaaaaaaauuuuaaaggacuaacacauucagcaaaugguuccuuagaaguaucugauauuguaaaauuacaaguacaaaaaguuuuauuaauuaaaaaaauagaagacuuaagaaagauagaauuauuuuuaaaaaaugcacaacuaaaagauaguauucauguaccaaauauuuauaaaccacaaaauaaaccagaaccauauuauuuaauuguauuaaaaaaagaaguagauaaauuaaaagaauuuauaccaaaaguaaaagacauguuaaagaaagaacaagcugucuuaucaaguauuacacaaccuuuaguugcagcaagcgaaacaacugaagaugggggucacuccacacacacauuaucccaaucaggagaaacagaaguaacagaagaaacagaagaaacagaagaaacaguaggacacacaacaacgguaacaauaacauuaccaccaacacaaccaucaccaccaaaagaaguaaaaguuguugaaaauucaauagaacauaagaguaaugacaauucacaagccuugacaaaaacaguuuaucuaaagaaauuagaugaauuuuuaacuaaaucauauauaugucauaaauauauuuuaguaucaaacucuaguauggaccaaaaauuauuagagguauauaaucuuacuccagaagaagaaaaugaauuaaaaucaugugauccauuagauuuauuauuuaauauucaaaauaacauaccugcuauguauucauuauaugauaguaugaacaaugauuuacaacaucucuuuuuugaauuauaucaaaaggaaaugauuuauuauuuacauaaacuaaaagaggaaaaucacaucaaaaaauuauuagaggagcaaaaacaaauaacuggaacaucaucuacauccaguccuggaaauacaaccguaaauacugcucaauccgcaacucacaguaauucccaaaaccaacaaucaaaugcauccucuaccaauacccaaaaugguguagcuguaucaucugguccugcuguaguugaagaaagucaugaucccuuaacaguauugucuauuaguaacgauuugaaagguauuguuagucucuuaaaucuuggaaauaaaacuaaaguaccuaauccauuaaccauuucuacaacagagauggaaaaauuuuaugagaauauuuuaaaaaauaaugauaccuauuuuaaugaugauaucaaacaauucguaaaaucuaauucaaaaguaauuacagguuugaccgaaacacaaaaaaaugcauuaaaugaugaaauuaaaaaauuaaaagauacuuuacaguuaucauuugauuuauauaauaaauauaaauuaaaauuagauagauuauuuaauaagaaaaaagaacuuggccaagacaaaaugcaaauuaaaaaacuuacuuuauuaaaagaacaauuagaaucaaaauugaauucacuuaauaacccacauaauguauuacaaaacuuuucuguuuucuuuaacaaaaaaaaagaagcugaaauagcagaaacugaaaacacauuagaaaacacaaaaauauuauugaaacauuauaaaggacuuguuaaauauuauaauggugaaucaucuccauuaaaaacuuuaagugaaguaucaauucaaacagaagauaauuaugccaauuuagaaaaauuuagaguauuaaguaaaauagauggaaaacucaaugauaauuuacauuuaggaaagaaaaaauuaucuuucuuaucaaguggauuacaucauuuaauuacugaauuaaaagaaguaauaaaaaauaaaaauuauacagguaauucuccaagugaaaauaauaagaaaguuaacgaagcuuuaaaaucuuacgaaaauuuucucccagaagcaaaaguuacaacaguuguaacuccaccucaaccagauguaacuccaucuccauuaucuguaaggguaagugguaguucaggauccacaaaagaagaaacacaaauaccaacuucaggcucuuuauuaacagaauuacaacaaguaguacaauuacaaaauuaugacgaagaagaugauuccuuaguuguauuacccauuuuuggagaauccgaagauaaugacgaauauuuagaucaaguaguaacuggagaagcaauaucugucacaauggauaauauccucucaggauuugaaaaugaauaugauguuauauauuuaaaaccuuuagcuggaguauauagaagcuuaaaaaaacaaauugaaaaaaacauuuuuacauuuaauuuaaauuugaacgauaucuuaaauucacgucuuaagaaacgaaaauauuucuuagauguauuagaaucugauuuaaugcaauuuaaacauauauccucaaaugaauacauuauugaagauucauuuaaauuauugaauucagaacaaaaaaacacacuuuuaaaaaguuacaaauauauaaaagaaucaguagaaaaugauauuaaauuugcacaggaagguauaaguuauuaugaaaagguuuuagcgaaauauaaggaugauuuagaaucaauuaaaaaaguuaucaaagaagaaaaggagaaguucccaucaucaccaccaacaacaccuccgucaccagcaaaaacagacgaacaaaagaaggaaaguaaguuccuuccauuuuuaacaaacauugagaccuuauacaauaacuuaguuaauaaaauugacgauuacuuaauuaacuuaaaggcaaagauuaacgauuguaauguugaaaaagaugaagcacauguuaaaauaacuaaacuuagugauuuaaaagcaauugaugacaaaauagaucuuuuuaaaaacccuuacgacuucgaagcaauuaaaaaauugauaaaugaugauacgaaaaaagauaugcuuggcaaauuacuuaguacaggauuaguucaaaauuuuccuaauacaauaauaucaaaauuaauugaaggaaaauuccaagauauguuaaacauuucacaacaccaaugcguaaaaaaacaauguccagaaaauucuggauguuucagacauuuagaugaaagagaagaauguaaauguuuauuaaauuacaaacaagaaggugauaaauguguugaaaauccaaauccuacuuguaacgaaaauaaugguggaugugaugcagaugccacauguaccgaagaagauucagguagcagcagaaagaaaaucacaugugaauguacuaaaccugauucuuauccacuuuucgaugguauuuucugcaguuccucuaacuucuuaggaauaucauucuuauuaauacucauguuaauauuauacaguuucauu

SEQ ID NO: 11 - RNA, 1866 nt, Plasmodium falciparum
augagaaaauuauacugcguauuauuauugagcgccuuugaguuuacauauaugauaaacuuuggaagaggacagaauuauugggaacauccauaucaaaauagugauguguaucguccaaucaacgaacauagggaacauccaaaagaauacgaauauccauuacaccaggaacauacauaccaacaagaagauucaggagaagacgaaaauacauuacaacacgcauauccaauagaccacgaaggugcugaacccgcaccacaagaacaaaacuuauucucaagcauugaaauagucgaacggucgaauuauauggguaauccguggacggaauacauggcaaaauaugauauugaagaaguucaugguucagguauaaggguagauuuaggagaggaugcugaaguagcuggaacucaauacagacuuccaucagguaaauguccaguauucgguaaagguauaauuauugagaauucaaauacuacuuuucuaacaccgguagcuacaggaaaucaauaucuaaaagauggaggguuugcguuuccuccaacagaaccucuuaugucaccaaugacacuagaugaaaugagacauuuuuauaaggauaauaaauacguaaaaaaccucgacgaauugacuuuauguucaagacaugcagggaauaugauuccagauaaugauaaaaacucaaauuauaaauacccggcuguuuaugaugauaaagauaaaaagugucauauccuguauauugcagcucaagaaaauaaugguccuagauauuguaauaaagacgaaaguaaaagaaacagcauguuuuguuucagaccagcaaaagacauaagcuuccaaaacuauacuuacuugucuaaaaauguaguugauaacugggaaaaagucugcccuagaaagaauuuacagaaugcgaaauucggacuaugggucgaugguaacugugaagauauaccacauguaaaugaauuuccagcaauagaucuuuucgaaugcaauaaacugguuuuugaauugagugccucggaucagccaaaacaguaugaacaacauuuaacagauuacgaaaaaaucaaagaagguuuuaaaaauaaaaaugcuaguaugaucaagagugcuuuucuucccacgggugcuuuuaaggcagaucguuauaaaagucacgguaaaggauauaauugggguaacuauaacacagagacacaaaagugugaaauuuuuaauguuaaaccaacaugucucauaaacaauuccucauacauugcuaccacugcuuuaucccaucccaucgaaguagagaacaauuuuccuuguagccuauacaaagaugaaauaaugaaagaaaucgagagagaaucaaaacgaauuaaauuaaaugauaacgaugacgaggggaacaaaaaaauuauagcuccacgcauuuuuauuucagacgauaaagacucguuaaaaugcccaugugacccugaaauggucaguaacaguacaugccgcuucuuuguauguaaauguguagaaaggagggcagaaguaacaucaaauaacgagguuguaguaaaagaagaauacaaagaugaguacgcagauauucccgaacacaaaccaaccuaugauaagaugaaaauaauaauagcaucaucagcugcaguugcuguacuagcgacgauuuuaaugguuuaucuuuauaaaagaaagggaaaugcugaaaaauaugauaaaauggaugaaccgcaagauuaugggaaauccaauucacgaaacgaugagaugcuugauccugaggcaucuuucuggggggaagaaaaaagagcaucacauacaacaccaguacugauggaaaaaccauacuau

SEQ ID NO: 12 - RNA, 1725 nt, Plasmodium falciparum
augaaucaucuugggaauguuaaauauuuagucauuguguuuuugauuuucuuugauuuguuucuaguuaaugguagagaugugcaaaacaauauaguggaugaaauaaaauaucgugaagaaguauguaaugaugagguagaucuuuaccuucuaauggauuguucuggaaguauacgucgucauaauugggugaaccaugcaguaccucuagcuaugaaauugauacaacaauuaaaucuuaaugauaaugcaauucacuuauaugcuaguguuuuuucaaacaaugcaagagaaauuauuagauuacauagugaugcaucuaaaaacaaagagaaggcuuuaauuauuauaaagucacucuuaaguacaaaucuuccauaugguaaaacaaacuuaacugaugcacuguuacaaguaagaaaacauuuaaaugaccgaaucaauagagagaaugcuaaucaauuaguuguuauauuaacagauggaauuccagauaguauucaagauucauuaaaagaaucaagaaaauuaagugaucgugguguuaaaauagcuguuuuugguauuggacaagguauuaauguagcuuucaacagauuucuuguagguugucauccaucagaugguaaauguaacuuguaugcugauucugcaugggaaaauguaaaaaauguuaucggacccuuuaugaaggcuguuuguguugaaguagaaaaaacagcaaguugugguguuugggacgaauggucuccauguaguguaacuugugguaaagguaccaggucaagaaaaagagaaaucuuacacgaaggauguacaagugaauuacaagaacaaugugaagaagaaagaugucuuccaaaacgggaaccauuagauguuccagaugaacccgaagaugaucaaccuagaccaagaggagauaauuuugcugucgaaaaaccaaacgaaaauauaauagauaauaauccacaagaaccuucaccaaauccagaagaaggaaagggugaaaauccaaacggauuugauuuagaugaaaauccagaaaauccaccaaauccaccaaauccaccaaauccaccaaauccaccaaauccaccaaauccagauauuccugaacaagaaccaaauauaccugaagauucagaaaaagaaguaccuucugauguuccaaaaaauccagaagacgaucgagaagaaaacuuugauauuccaaagaaacccgaaaauaagcacgauaaucaaaauaauuuaccaaaugauaaaagugauagauauauuccauauucaccauuaucuccaaaaguuuuggauaaugaaaggaaacaaagugacccccaaagucaagauaauaauggaaauaggcacguaccuaauagugaagauagagaaacacguccacaugguagaaauaaugaaaauagaucauacaauagaaaacauaacaauacuccaaaacauccugaaagggaagaacaugaaaagccagauaauaauaaaaaaaaagcaggaucagauaauaaauauaaaauugcagguggaauagcuggaggauuagcuuuacucgcaugugcuggacuugcuuauaaauucguaguaccaggagcagcaacacccuaugccggagaaccugcaccuuuugaugaaacauuaggugaagaagauaaagauuuggacgaaccugaacaauucagauuaccugaagaaaacgaguggaauuaa

SEQ ID NO: 13 - protein, 579 aa, Plasmodium falciparum
MNHLGNVKYLVIVFLIFFDLFLVNGRDVQNNIVDEIKYREEVCNDEVDLYLLMDCSGSIRRHNWVNHAVPLAMKLIQQLNLNDNAIHLYASINVFSNNAREIIRLHSDASKNKEKALIIIKSLLSTNLPYGKTNLTDALLQVRKHLNDRINRENANQLVVILTDGIPDSIQDSLKESRKLSDRGVKIAVFGIGQGINVAFNRFLVGCHPSDGKCNLYADSAWENVKNVIGPFMKAVCVEVEKTASCGVWDEWSPCSINVTCGKGTRSRKREILHEGCTSELQEQCEEEVRCLPKREPLDVPDEPEDDQPRPRGDNFAVEKPNENIIDNNPQEPSPNPEEGKGENPNGFDLDENPENPPNPPNPPNPPNPPNPPNPDIPEQEPNIPEDSEKEVPSDVPKNPEDDREENFDIPKKPENKHDNQNNLPNDKSDRYIPYSPLSPKVLDNERKQSDPQSQDNNGNRHVPNSEDRETRPHGRNNENRSYNRKHNNTPKHPEREEHEKPDNNKKKAGSDNKYKIAGGIAGGLALLACAGLAYKFVVPGAATPYAGEPAPFDETLGEEDKDLDEPEQFRLPEENEWN

SEQ ID NO: 14 - protein, 622 aa, Plasmodium falciparum
MRKLYCVLLLSAFEFTYMINFGRGQNYWEHPYQNSDVYRPINEHREHPKEYEYPLHQEHTYQQEDSGEDENTLQHAYPIDHEGAEPAPQEQNLFSSIEIVERSNYMGNPWTEYMAKYDIEEVHGSGIRVDLGEDAEVAGTQYRLPSGKCPVFGKGIIIENSNTTFLTPVATGNQYLKDGGFAFPPTEPLMSPMTLDEMRHFYKDNKYVKNLDELTLCSRHAGNMIPDNDKNSNYKYPAVYDDKDKKCHILYIAAQENNGPRYCNKDESKRNSMFCFRPAKDISFQNYTYLSKNVVDNWEKVCPRKNLQNAKFGLWVDGNCEDIPHVNEFPAIDLFECNKLVFELSASDQPKQYEQHLTDYEKIKEGFKNKNASMIKSAFLPTGAFKADRYKSHGKGYNWGNYNTETQKCEIFNVKPTCLINNSSYIATTALSHPIEVENNFPCSLYKDEIMKEIERESKRIKLNDNDDEGNKKIIAPRIFISDDKDSLKCPCDPEMVSNSTCRFFVCKCVERRAEVTSNNEVVVKEEYKDEYADIPEHKPTYDKMKIIIASSAAVAVLATILMVYLYKRKGNAEKYDKMDEPQDYGKSNSRNDEMLDPEASFWGEEKRASHTTPVLMEKPYY

SEQ ID NO: 15 - protein, 1736 aa, Plasmodium falciparum
MKIIFFLCSFLFFIINTQCVTHESYQELVKKLEALEDAVLTGYSLFQKEKMVLNEEEVITTKGASAQSGASAQSGASAQSGASAQSGASAQSGASAQSGTSGPSGPSGTSPSSRSNTLPRSNTSSGASPPADASDSDAKSYADLKHRVRNYLFTIKELKYPELFDLTNHMLTLCDNIHGFKYLIDGYEEINELLYKLNFYFDLLRAKLNDVCANDYCQIPFNLKIRANELDVLKKLVFGYRKPLDNIKDNVGKMEDYIKKNKTTIANINELIEGSKKTIDQNKNADNEEGKKKLYQAQYDLSIYNKQLEEAHNLISINVLEKRIDTLKKNENIKKLLDKINEIKNPPPANSGNTPNTLLDKNKKIEEHEEKIKEIAKTIKFNIDSLFTDPLELEYYLREKNKKVDVTPKSQDPTKSINVQIPKVPYPNGIVYPLPLTDIHNSLAADNDKNSYGDLMNPHTKEKINEKIITDNKERKIFINNIKKKIDLEEKNINHTKEQNKKLLEDYEKSKKDYEELLEKFYEMKFNNNFNKDVVDKIFSARYTYNVEKQRYNNKFSSSNNSINVYNVQKLKKALSYLEDYSLRKGISEKDFNHYYTLKTGLEADIKKLTEEIKSSENKILEKNFKGLTHSANGSLEVSDIVKLQVQKVLLIKKIEDLRKIELFLKNAQLKDSIHVPNIYKPQNKPEPYYLIVLKKEVDKLKEFIPKVKDMLKKEQAVLSSITQPLVAASETTEDGGHSTHTLSQSGETEVTEETEETEETVGHTTTVTITLPPTQPSPPKEVKVVENSIEHKSNDNSQALTKTVYLKKLDEFLTKSYICHKYILVSNSSMDQKLLEVYNLTPEEEVNELKSCDPLDLLFNIQNNIPAMYSLYDSMNNDLQHLFFELYQKEMIYYLHKLKEENHIKKLLEEQKQITGTSSTSSPGNTTVNTAQSATHSNSQNQQSNASSTNTQNGVAVSSGPAVVEESHDPLTVLSISNDLKGIVSLLNLGNKTKVPNPLTISTTEMEKFYENILKNNDTYFNDDIKQFVKSNSKVITGLTETQKNALNDEIKKLKDTLQLSFDLYNKYKLKLDRLFNKKKELGQDKMQIKKLTLLKEQLESKLNSLNNPHNVLQNFSINVFFNKKKEAEIAETENTLENTKILLKHYKGLVKYYNGESSPLKTLSEVSIQTEDNYANLEKFRVLSKIDGKLNDNLHLGKKKLSFLSSGLHHLITELKEVIKNKNYTGNSPSENNKKVNEALKSYENFLPEAKVTTVVTPPQPDVTPSPLSINVRVSGSSGSTKEETQIPTSGSLLTELQQVVQLQNYDEEDDSLVVLPIFGESEDNDEYLDQVVTGEAISINVTMDNILSGFENEYDVIYLKPLAGVYRSLKKQIEKNIFTFNLNLNDILNSRLKKRKYFLDVLESDLMQFKHISSNEYIIEDSFKLLNSEQKNTLLKSYKYIKESINVENDIKFAQEGISYYEKVLAKYKDDLESIKKVIKEEKEKFPSSPPTTPPSPAKTDEQKKESKFLPFLTNIETLYNNLVNKIDDYLINLKAKINDCNVEKDEAHVKITKLSDLKAIDDKIDLFKNPYDFEAIKKLINDDTKKDMLGKLLSTGLVQNFPNTIISKLIEGKFQDMLNISQHQCVKKQCPENSGCFRHLDEREECKCLLNYKQEGDKCVENPNPTCNENNGGCDADATCTEEDSGSSRKKITCECTKPDSYPLFDGIFCSSSNFLGISFLLILMLILYSFI

SEQ ID NO: 16 - protein, 520 aa, Plasmodium falciparum
MKHILYISFYFILVNLLIFQINGKILKKSENDEIIKSNLRSGSSNSLNQIYEEKHEKKHALSHNSYDKTKNNENHKFFDKDKEVSISNLKNVSQTNVKNALRNFGVSENIFLQENKLGEEGKLINHITNDDENKEKYIKGEEEVNREEDPEEKAARERQEAEEKAARERQEAEEKAAREKQEAEEKAARERQVAEKAAREKQEAEEKAAREKQEAEEKAAREREESPKRALAEQRAAFERIDSMKQKLEGGKEHGDVLAEDLYGRLEIPVIELPSENEGGYYIQHQSSLPQDNRGNSRDSKEISIIEKTNRESITTNVEGRRDIHKGHLEEKKDVSIKPEQKEDKSADVQNHALETVNILDVKDFQISEYEDEISAEYDDSLIDEEEVDDEDLDQFKPIVQYDNFQDEENIGIYKELEDLIEKNENLDDLDEGIEKSSEELSEEKKKKGKKYEKTKDTNFKPNDKSLYDEHIKKYKNVKQINKEKEKFIKSLFHIFDGDNEILQIVDELSEDITKYFMKL

SEQ ID NO: 17 - protein, 403 aa, Plasmodium falciparum
MMRKLAILSINVSSFLFVEALFQEYQCYGSSSNTRVLNELNYDNAGTNLYNELEMNYYGKQENWYSLKKNSRSLGENDDGNNEDNEKLRKPKHKKLKQPADGNPDPNANPNVDPNANPNVDPNANPNVDPNANPNANPNANPNANPNANPNANPNANPNANPNANPNANPNANPNANPNANPNANPNANPNANPNANPNVDPNANPNANPNANPNANPNANPNANPNANPNANPNANPNANPNANPNANPNANPNANPNANPNANPNANPNANPNKNNQGNGQGHNMPNDPNRNVDENANANSAVKNNNNEEPSDKHIKEYLNKIQNSLSTEWSPCSINVTCGNGIQVRIKPGSANKPKDELDYANDIEKKICKMEKCSSINVFNVVNSSIGLIMVLSFLFLN

SEQ ID NO: 18 - DNA, 1572 bp, Japanese encephalitis virus
atgcttggcagcaatagtggtcaacgtgtggtgttcactatcctcctgctgttggtcgctccggcttacagttttaactgtctgggaatggggaatcgagatttcatagaaggagccagtggagccacttgggtggatctggtattagaaggagacagttgtttgacaatcatggcaaacgacaaaccaacactagatgtccgcatgatcaacattgaagccagccaactcgctgaagttaggagctactgctatcacgcttcagtcactgacatttcaacggtggctcgatgccccacgactggagaagctcacaacgagaaacgtgctgacagcagctacgtgtgcaagcaaggctttactgaccgcggatggggaaatggatgtggacttttcgggaaaggaagcattgacacttgcgcaaagtttacttgtactaataaggccattggaagaacaatccaaccagagaacatcaagtatgaagttggtgtattcgtgcacggaaccaccacctcggaaaaccatgggaattactcagcgcaggttggagcgtctcaagcagcaaagtttactgtaactccaaacgctccctcaataaccctcaagcttggtgattatggagaagttacactggattgtgaaccaaggagtggactgaacactgaagcgttctatgtcatgactgtgggttcgaagtcattcttagtccatagggaatggttccatgacctttctcttccctggacatccccctcaagcacggcatggaggaacagagaactccttatggaatttgaagaggcacatgccacaaaacaatctgtcgtagcccttgggtcacaggagggaggcctccatcaagcgttagcaggagccatcgtggtggagtactcaagctcagtgaagttgacatcaggtcacctgaaatgcaggctgaaaatggacaaactggctctgaagggcacgacttatggcatgtgcacagaaaaattctcgttcgcgaaaaacccagcggacacaggccatggaacagttgtcattgagctcacatactctggaagcgatggtccctgcaaaattccgattgtttcagtcgcgagtttaaacgacatgacccctgtgggaaggctggtaacagtaaaccccttcgtcgcgacatccagctccaactcgaaggtgctggttgagatggaacctcctttcggagactcttatattgtggttggaagaggggacaagcagattaaccatcactggcacaaagctggaagcacgttgggcaaagccttctcaacaactttgaaaggagctcaaagactggcagcgctaggggacacagcctgggactttggttccattgggggggtactcaactccataggaaaagctgttcaccaagtatttggcggtgcatttagaacgctttttgggggaatgtcttggatcacgcaagggctaatgggggccctacttctctggatgggtgtcaacgcacgagatcggtcaatcgccttagcttttttggccacgggaggtgtgctcgtctttttagcgaccaacgtgcatgct

SEQ ID NO: 19 - DNA, 2046 bp, Japanese encephalitis virus
atgtggcttgtcagcttggcaatcgtaacagcttgtgccggagctatgaagctatcaaactttcaaggaaagcttctgatgaccatcaacaacacggacattgcggacgtcatcgtgatccctacctcaaaaggcgaaaacagatgttgggtccgagcgatcgacgttggttacatgtgtgaagacaccattacgtacgaatgtccgaagctagcagtgggcaacgacccagaagacgtggattgctggtgcgacaatcaagaagtcttcgtgcagtatggtcgctgcacacggaccaggcattccaaacgaagcagaagatccgtttcggtccaaacgcatggtgaaagctcactagtgaacaaaaaagaggcttggctggattcaacgaaggccacgcgatacctcatgaaaacggagaattggatcataaggaaccctggttatgctttcctggcggcggcacttggttggatgcttggcagcaatagtggtcaacgtgtggtgttcactatcctcctgctgttggtcgctccggcttacagttttaactgtctgggaatggggaatcgagatttcatagaaggagccagtggagccacttgggtggatctggtattagaaggagacagttgtttgacaatcatggcaaacgacaaaccaacactagatgtccgcatgatcaacattgaagccagccaactcgctgaagttaggagctactgctatcacgcttcagtcactgacatttcaacggtggctcgatgccccacgactggagaagctcacaacgagaaacgtgctgacagcagctacgtgtgcaagcaaggctttactgaccgcggatggggaaatggatgtggacttttcgggaaaggaagcattgacacttgcgcaaagtttacttgtactaataaggccattggaagaacaatccaaccagagaacatcaagtatgaagttggtgtattcgtgcacggaaccaccacctcggaaaaccatgggaattactcagcgcaggttggagcgtctcaagcagcaaagtttactgtaactccaaacgctccctcaataaccctcaagcttggtgattatggagaagttacactggattgtgaaccaaggagtggactgaacactgaagcgttctatgtcatgactgtgggttcgaagtcattcttagtccatagggaatggttccatgacctttctcttccctggacatccccctcaagcacggcatggaggaacagagaactccttatggaatttgaagaggcacatgccacaaaacaatctgtcgtagcccttgggtcacaggagggaggcctccatcaagcgttagcaggagccatcgtggtggagtactcaagctcagtgaagttgacatcaggtcacctgaaatgcaggctgaaaatggacaaactggctctgaagggcacgacttatggcatgtgcacagaaaaattctcgttcgcgaaaaacccagcggacacaggccatggaacagttgtcattgagctcacatactctggaagcgatggtccctgcaaaattccgattgtttcagtcgcgagtttaaacgacatgacccctgtgggaaggctggtaacagtaaaccccttcgtcgcgacatccagctccaactcgaaggtgctggttgagatggaacctcctttcggagactcttatattgtggttggaagaggggacaagcagattaaccatcactggcacaaagctggaagcacgttgggcaaagccttctcaacaactttgaaaggagctcaaagactggcagcgctaggggacacagcctgggactttggttccattgggggggtactcaactccataggaaaagctgttcaccaagtatttggcggtgcatttagaacgctttttgggggaatgtcttggatcacgcaagggctaatgggggccctacttctctggatgggtgtcaacgcacgagatcggtcaatcgccttagcttttttggccacgggaggtgtgctcgtctttttagcgaccaacgtgcatgct

SEQ ID NO: 20 - RNA, 1572 nt, Japanese encephalitis virus
augcuuggcagcaauaguggucaacgugugguguucacuauccuccugcuguuggucgcuccggcuuacaguuuuaacugucugggaauggggaaucgagauuucauagaaggagccaguggagccacuuggguggaucugguauuagaaggagacaguuguuugacaaucauggcaaacgacaaaccaacacuagauguccgcaugaucaacauugaagccagccaacucgcugaaguuaggagcuacugcuaucacgcuucagucacugacauuucaacgguggcucgaugccccacgacuggagaagcucacaacgagaaacgugcugacagcagcuacgugugcaagcaaggcuuuacugaccgcggauggggaaauggauguggacuuuucgggaaaggaagcauugacacuugcgcaaaguuuacuuguacuaauaaggccauuggaagaacaauccaaccagagaacaucaaguaugaaguugguguauucgugcacggaaccaccaccucggaaaaccaugggaauuacucagcgcagguuggagcgucucaagcagcaaaguuuacuguaacuccaaacgcucccucaauaacccucaagcuuggugauuauggagaaguuacacuggauugugaaccaaggaguggacugaacacugaagcguucuaugucaugacuguggguucgaagucauucuuaguccauagggaaugguuccaugaccuuucucuucccuggacaucccccucaagcacggcauggaggaacagagaacuccuuauggaauuugaagaggcacaugccacaaaacaaucugucguagcccuugggucacaggagggaggccuccaucaagcguuagcaggagccaucgugguggaguacucaagcucagugaaguugacaucaggucaccugaaaugcaggcugaaaauggacaaacuggcucugaagggcacgacuuauggcaugugcacagaaaaauucucguucgcgaaaaacccagcggacacaggccauggaacaguugucauugagcucacauacucuggaagcgauggucccugcaaaauuccgauuguuucagucgcgaguuuaaacgacaugaccccugugggaaggcugguaacaguaaaccccuucgucgcgacauccagcuccaacucgaaggugcugguugagauggaaccuccuuucggagacucuuauauugugguuggaagaggggacaagcagauuaaccaucacuggcacaaagcuggaagcacguugggcaaagccuucucaacaacuuugaaaggagcucaaagacuggcagcgcuaggggacacagccugggacuuugguuccauuggggggguacucaacuccauaggaaaagcuguucaccaaguauuuggcggugcauuuagaacgcuuuuugggggaaugucuuggaucacgcaagggcuaaugggggcccuacuucucuggaugggugucaacgcacgagaucggucaaucgccuuagcuuuuuuggccacgggaggugugcucgucuuuuuagcgaccaacgugcaugcu

SEQ ID NO: 21 - RNA, 2046 nt, Japanese encephalitis virus
auguggcuugucagcuuggcaaucguaacagcuugugccggagcuaugaagcuaucaaacuuucaaggaaagcuucugaugaccaucaacaacacggacauugcggacgucaucgugaucccuaccucaaaaggcgaaaacagauguuggguccgagcgaucgacguugguuacaugugugaagacaccauuacguacgaauguccgaagcuagcagugggcaacgacccagaagacguggauugcuggugcgacaaucaagaagucuucgugcaguauggucgcugcacacggaccaggcauuccaaacgaagcagaagauccguuucgguccaaacgcauggugaaagcucacuagugaacaaaaaagaggcuuggcuggauucaacgaaggccacgcgauaccucaugaaaacggagaauuggaucauaaggaacccugguuaugcuuuccuggcggcggcacuugguuggaugcuuggcagcaauaguggucaacgugugguguucacuauccuccugcuguuggucgcuccggcuuacaguuuuaacugucugggaauggggaaucgagauuucauagaaggagccaguggagccacuuggguggaucugguauuagaaggagacaguuguuugacaaucauggcaaacgacaaaccaacacuagauguccgcaugaucaacauugaagccagccaacucgcugaaguuaggagcuacugcuaucacgcuucagucacugacauuucaacgguggcucgaugccccacgacuggagaagcucacaacgagaaacgugcugacagcagcuacgugugcaagcaaggcuuuacugaccgcggauggggaaauggauguggacuuuucgggaaaggaagcauugacacuugcgcaaaguuuacuuguacuaauaaggccauuggaagaacaauccaaccagagaacaucaaguaugaaguugguguauucgugcacggaaccaccaccucggaaaaccaugggaauuacucagcgcagguuggagcgucucaagcagcaaaguuuacuguaacuccaaacgcucccucaauaacccucaagcuuggugauuauggagaaguuacacuggauugugaaccaaggaguggacugaacacugaagcguucuaugucaugacuguggguucgaagucauucuuaguccauagggaaugguuccaugaccuuucucuucccuggacaucccccucaagcacggcauggaggaacagagaacuccuuauggaauuugaagaggcacaugccacaaaacaaucugucguagcccuugggucacaggagggaggccuccaucaagcguuagcaggagccaucgugguggaguacucaagcucagugaaguugacaucaggucaccugaaaugcaggcugaaaauggacaaacuggcucugaagggcacgacuuauggcaugugcacagaaaaauucucguucgcgaaaaacccagcggacacaggccauggaacaguugucauugagcucacauacucuggaagcgauggucccugcaaaauuccgauuguuucagucgcgaguuuaaacgacaugaccccugugggaaggcugguaacaguaaaccccuucgucgcgacauccagcuccaacucgaaggugcugguugagauggaaccuccuuucggagacucuuauauugugguuggaagaggggacaagcagauuaaccaucacuggcacaaagcuggaagcacguugggcaaagccuucucaacaacuuugaaaggagcucaaagacuggcagcgcuaggggacacagccugggacuuugguuccauuggggggguacucaacuccauaggaaaagcuguucaccaaguauuuggcggugcauuuagaacgcuuuuugggggaaugucuuggaucacgcaagggcuaaugggggcccuacuucucuggaugggugucaacgcacgagaucggucaaucgccuuagcuuuuuuggccacgggaggugugcucgucuuuuuagcgaccaacgugcaugcu

SEQ ID NO: 22 - protein, 532 aa, Japanese encephalitis virus
MLGSNSGQRVVFTILLLLVAPAYSFNCLGMGNRDFIEGASGATWVDLVLEGDSCLTIMANDKPTLDVRMINIEASQLAEVRSYCYHASINVTDISTVARCPTTGEAHNEKRADSSYVCKQGFTDRGWGNGCGLFGKGSIDTCAKFTCTNKAIGRTIQPENIKYEVGVFVHGTTTSENHGNYSAQVGASQAAKFTVTPNAPSITLKLGDYGEVTLDCEPRSGLNTEAFYVMTVGSKSFLVHREWFHDLSLPWTSPSSTAWRNRELLMEFEEAHATKQSINVVALGSQEGGLHQALAGAIVVEYSSSINVKLTSGHLKCRLKMDKLALKGTTYGMCTEKFSFAKNPADTGHGTVVIELTYSGSDGPCKIPIVSINVASLNDMTPVGRLVTVNPFVATSSSNSKVLVEMEPPFGDSYIVVGRGDKQINHHWHKAGSTLGKAFSTTLKGAQRLAALGDTAWDFGSIGGVLNSIGKAVHQVFGGAFRTLFGGMSWITQGLMGALLLWMGVNARDRSIALAFLATGGVLVFLATNVHA

SEQ ID NO: 23 - protein, 694 aa, Japanese encephalitis virus
MWLVSLAIVTACAGAMKLSNFQGKLLMTINNTDIADVIVIPTSKGENRCWVRAIDVGYMCEDTITYECPKLAVGNDPEDVDCWCDNQEVFVQYGRCTRTRHSKRSRRSINVSINVQTHGESSLVNKKEAWLDSTKATRYLMKTENWIIRNPGYAFLAAALGWMLGSNSGQRVVFTILLLLVAPAYSFNCLGMGNRDFIEGASGATWVDLVLEGDSCLTIMANDKPTLDVRMINIEASQLAEVRSYCYHASINVTDISTVARCPTTGEAHNEKRADSSYVCKQGFTDRGWGNGCGLFGKGSIDTCAKFTCTNKAIGRTIQPENIKYEVGVFVHGTTTSENHGNYSAQVGASQAAKFTVTPNAPSITLKLGDYGEVTLDCEPRSGLNTEAFYVMTVGSKSFLVHREWFHDLSLPWTSPSSTAWRNRELLMEFEEAHATKQSINVVALGSQEGGLHQALAGAIVVEYSSSINVKLTSGHLKCRLKMDKLALKGTTYGMCTEKFSFAKNPADTGHGTVVIELTYSGSDGPCKIPIVSINVASLNDMTPVGRLVTVNPFVATSSSNSKVLVEMEPPFGDSYIVVGRGDKQINHHWHKAGSTLGKAFSTTLKGAQRLAALGDTAWDFGSIGGVLNSIGKAVHQVFGGAFRTLFGGMSWITQGLMGALLLWMGVNARDRSIALAFLATGGVLVFLATNVHA

SEQ ID NO: 24 - protein, 825 aa, Japanese encephalitis virus
MTKKPGGPGKNRAINMLKRGLPRVFPLVGVKRVVMSLLDGRGPVRFVLALITFFKFTALAPTKALLGRWRAVEKSINVAMKHLTSFKRELGTLIDAVNKRGKKQNKRGGNESSIMWLVSLAIVTACAGAMKLSNFQGKLLMTINNTDIADVIVIPTSKGENRCWVRAIDVGYMCEDTITYECPKLAVGNDPEDVDCWCDNQEVFVQYGRCTRTRHSKRSRRSINVSINVQTHGESSLVNKKEAWLDSTKATRYLMKTENWIIRNPGYAFLAAALGWMLGSNSGQRVVFTILLLLVAPAYSFNCLGMGNRDFIEGASGATWVDLVLEGDSCLTIMANDKPTLDVRMINIEASQLAEVRSYCYHASINVTDISTVARCPTTGEAHNEKRADSSYVCKQGFTDRGWGNGCGLFGKGSIDTCAKFTCNNKAIGRTIQPENIKYEVGVFVHGTTTSENHGNYSAQVGASQAAKFTVTPNAPSITLKLGDYGEVTLDCEPRSGLNTEAFYVMTVGSKSFLVHREWFHDLSLPWTSPSSTAWRNRELLMEFEEAHATKQSINVVALGSQEGGLHQALAGAIVVEYSSSINVKLTSGHLKCRLKMDKLALKGTTYGMCTEKFSFAKNPADTGHGTVVIELTYSGSDGPCKIPIVSINVASLNDMTPVGRLVTVNPFVATSSSNSKVLVEMEPPFGDSYIVVGRGDKQINHHWHKAGSTLGKAFSTTLKGAQRLAALGDTAWDFGSIGGVLNSIGKAVHQVFGGAFRTLFGGMSWITQGLMGALLLWMGVNARDRSIALAFLATGGVLVFLATNVHADTGCAIDITRKEMRCGS

SEQ ID NO: 25 - protein, 3462 aa, Japanese encephalitis virus
MTKKPGGPGKNRAINMLKRGLPRVFPLVGVKRVVMSLLDGRGPVRFVLALITFFKFTALAPTKALLGRWRAVEKSINVAMKHLTSFKRELGTLIDAVNKRGKKQNKRGGNESSIMWLASLAIVTACAGAMKLSNFQGKLLMTINNTDIADVIVIPTSKGENRCWVRAIDVGYMCEDTITYECPKLAVGNDPEDVDCWCDNQEVYVQYGRCTRTRHSKRSRRSINVSINVQTHGESSLVNKKEAWLDSTKATRYLMKTENWIIRNPGYAFLAAALGWMLGSNSGQRVVFTILLLLVAPAYSFNCLGMGNRDFIEGASGATWVDLVLEGDSCLTIMANDKPTLDVRMINIEASQLAEVRSYCYHASINVTDISTVARCPTTGEAHNEKRADSSYVCKQGFTDRGWGNGCGLFGKGSIDTCAKFSCTNKAIGRMIQPENIKYEVGIFVHGTTTSENHGNYSAQVGASQAAKFTVTPNAPSITLKLGDYGEVTLDCEPRSGLNTEAFYVMTVGSKSFLVHREWFHDLSLPWTSPSSTAWRNRELLMEFEEAHATKQSINVVALGSQEGGLHQALAGAIVVEYSSSINVKLTSGHLKCRLKMDKLALKGTTYGMCTEKFSFAKNPADTGHGTVVIELTYSGSDGPCKIPIVSINVASLNDMTPVGRLVTVNPFVATSSSNSKVLVEMEPPFGDSYIVVGRGDKQINHHWHKAGSTLGKAFSTTLKGAQRLAALGDTAWDFGSIGGVFNSIGKAVHQVFGGAFRTLFGGMSWITQGLMGALLLWMGVNARDRSIALAFLATGGVLVFLATNVHADTGCAIDITRKEMRCGSGIFVHNDVEAWVDRYKYLPETPRSLAKIVHKAHQEGVCGVRSINVTRLEHQMWESINVRDELNVLLKENAVDLSINVVVNKPVGRYRSAPKRLSMTQEKFEMGWKAWGKSILFAPELANSTFVVDGPETKECPDERRAWNSMQIEDFGFGITSTRVWLKIREENTDECDGAIIGTAVKGHVAVHSDLSYWIESRLNDTWKLERAVFGEVKSCTWPETHTLWGDGVEESELIIPHTIAGPRSKHNRREGYKTQNQGPWDENGIVLDFDYCPGTKVTITEDCGKRGPSIRTTTDSGKLITDWCCRSCSLPPLRFRTENGCWYGMEIRPVRHDETTLVRSQVDAFNGEMIDPFQLGLLVMFLATQEVLRKRWTARLTIPAVLGALLVLMLGGITYTDMARYVVLVAAAFAEANSGGDVLHLALIAVFKIQPSFLVMNMLSARWTNQENVVLVLGAAFFQLASINVDLQIGVHGILNAAAIAWMIVRAITFPTTSTVAMPVLALLTPGMRALYLDTYRIILLVIGICSLLQERRKTMAKKKGAVLLGLALTSTGWFSPTTIAAGLMVCNPNKKRGWPATEFLSAVGLMFAIVGGLAELDIESMSIPFMLAGLMAVSYVVSGKATDMWLDRAADISWEMEAAITGSSRRLDVKLDDDGDFHLIDDPGVPWKVWLLRMSCIGLAALTPWAIVPAAFGYWLTLKTTKRGGVFWDTPSPKPCLKGDTTTGVYRIMARGILGTYQAGVGVMYENVFHTLWHTTRGAAIMSGEGKLTPYWGSINVKEDRISYGGPWRFDRKWNGTDDVQVIVVEPGKPAVNIQTKPGVFRTPFGEIGAVSLDYPRGTSGSPILDSNGDIIGLYGNGVELGDGSYVSAIVQGDRQEEPVPDAYTPGMLKKRQMTVLDLHPGSGKTRKILPQIIKDAIQQRLRTAVLAPTRVVAAEMAEALKGLPVRYQTSAVQREHQGNEIVDVMCHATLTHRLMSPNRVPNYNLFVMDEAHFTDPASIAARGYIATKVELGEAAAIFMTATPPGTTDPFPDSNAPIHDLQDEIPDRAWSSGYEWITDYAGKTVWFVASINVKMGNEIAMCLQRAGKKVIQLNRKSYDTEYPKCKNGDWDFVITTDISEMGANFGASRVIDCRKSINVKPTILEEGEGRVILGNPSPITSASAAQRRGRVGRNPNQVGDEYHYGGATSEDDSNLAHWTEAKIMLDNIHMPNGLVAQLYGPEREKAFTMDGEYRLRGEEKKNFLELLRTADLPVWLAYKVASNGIQYTDRKWCFDGPRTNAILEDNTEVEIVTRMGERKILKPRWLDARVYADHQALKWFKDFAAGKRSAVSFIEVLGRMPEHFMGKTREALDTMYLVATAEKGGKAHRMALEELPDALETITLIVAITVMTGGFFLLMMQRKGIGKMGLGALVLTLATFFLWAAEVPGTKIAGTLLVALLLMVVLIPEPEKQRSQTDNQLAVFLICVLTVVGVVAANEYGMLEKTKADLKSMFGGRTQASGLTGLPSMALDLRPATAWALYGGSTVVLTPLLKHLITSEYVTTSLASISSQAGSLFVLPRGVPFTDLDLTVGLVFLGCWGQITLTTFLTAMVLVTLHYGYMLPGWQAEALRAAQRRTAAGIMKNAVVDGMVATDVPELERTTPLMQKKVGQVLLIGVSINVAAFLVNPNVTTVREAGVLVTAATLTLWDNGASAVWNSTTATGLCHVMRGSYLAGGSIAWTLIKNADKPSLKRGRPGGRTLGEQWKEKLNAMSRDEFFKYRREAIIEVDRTEARRARRENNIVGGHPVSRGSAKLRWLVEKGFVSPIGKVIDLGCGRGGWSYYAATLKKVQEVKGYTKGGAGHEEPMLMQSYGWNLVSLKSGVDVFYKPSEPSDTLFCDIGESSPSPEVEEQRTLRVLEMTSDWLHRGPREFCIKVLCPYMPKVIEKMEVLQRRFGGGLVRLPLSRNSNHEMYWVSGAAGNVVHAVNMTSQVLLGRMDRTVWRGPKYEEDVNLGSGTRAVGKGEVHSNQEKIRKRIQKLKEEFATTWHKDPEHPYRTWTYHGSYEVKATGSASSLVNGVVKLMSKPWDAIANVTTMAMTDTTPFGQQRVFKEKVDTKAPEPPAGVKEVLNETTNWLWAHLSREKRPRLCTKEEFIKKVNSNAALGAVFAEQNQWSTAREAVGDPLFWEMVNEERENHLRGECHTCIYNMMGKREKKPGEFGKAKGSRAIWFMWLGARYLEFEALGFLNEDHWLSRENSGGGVEGSGVQKLGYILRDIAGKQGGKMYADDTAGWDTRITRTDLENEAKVLELLDGEHRMLARAIIELTYRHKVVKVMRPAAGGKTVMDVISREDQRGSGQVVTYALNTFTNIAVQLVRLMEAEGVIGPQHLEQLPRKNKIAVRTWLFENGEERVTRMAISGDDCVVKPLDDRFATALHFLNAMSKVRKDIQEWKPSHGWHDWQQVPFCSNHFQEIVMKDGRSIVVPCRGQDELIGRARISPGAGWNVKDTACLAKAYAQMWLLLYFHRRDLRLMANAICSAVPVDWVPTGRTSWSIHSKGEWMTTEDMLQVWNRVWIEENEWMMDKTPITSWTDVPYVGKREDIWCGSLIGTRSRATWAENVYAAINQVRAIIGKENYVDYMTSLRRYEDVLIQEDRVI

SEQ ID NO: 26 - protein, 3462 aa, Japanese encephalitis virus
MTKKPGGPGKNRAINMLKRGLPRVFPLVGVKRVVMSLLDGRGPVRFVLALITFFKFTALAPTKALLGRWRAVEKSINVAMKHLTSFKRELGTLIDAVNKRGKKQNKRGGNESSIVWLASLAIVTACAGAMKLSNFQGKLLMTINNTDIADVIVIPTSKGENRCWVRAIDVGYMCEDTITYECPKLAVGNDPEDVDCWCDNQEVYVQYGRCTRTRHSKRSRRSINVSINVQTHGESSLVNKKEAWLDSTKATRYLMKTENWIIRNPGYAFLAAALGWMLGSNSGQRVVFTILLLLVAPAYSFNCLGMGNRDFIEGASGATWVDLVLEGDSCLTIMANDKPTLDVRMINIEASQLAEVRSYCYHASINVTDISTVARCPTTGEAHNEKRADSSYVCKQGFTDRGWGNGCGLFGKGSIDTCAKFSCTNKAIGRMIQPENIKYEVGIFVHGTTTSENHGNYSAQVGASQAAKFTVTPNAPSITLKLGDYGEVTLDCEPRSGLNTEAFYVMTVGSKSFLVHREWFHDLSLPWTSPSSTAWRNRELLMEFEEAHATKQSINVVALGSQEGGLHQALAGAIVVEYSSSINVKLTSGHLKCRLKMDKLALKGTTYGMCTEKFSFAKNPADTGHGTVVIELTYSGSDGPCKIPIVSINVASLNDMTPVGRLVTVNPFVATSSSNSKVLVEMEPPFGDSYIVVGRGDKQINHHWHKAGSTLGKAFSTTLKGAQRLAALGDTAWDFGSIGGVFNSIGKAVHQVFGGAFRTLFGGMSWITQGLMGALLLWMGVNARDRSIALAFLATGGVLVFLATNVHADTGCAIDITRKEMRCGSGIFVHNDVEAWVDRYKYLPETPRSLAKIVHKAHQEGVCGVRSINVTRLEHQMWESINVRDELNVLLKENAVDLSINVVVNKPVGRYRSAPKRLSMTQEKFEMGWKAWGKSILFAPELANSTFVVDGPETKECPDERRAWNSMQIEDFGFGITSTRVWLKIREENTDECDGAIIGTAVKGHVAVHSDLSYWIESRLNDTWKLERAVFGEVKSCTWPETHTLWGDGVEESELIIPHTIAGPRSKHNRREGYKTQNQGPWDENGIVLDFDYCPGTKVTITEDCGKRGPSIRTTTDSGKLITDWCCRSCSLPPLRFRTENGCWYGMEIRPVRHDETTLVRSQVDAFNGEMIDPFQLGLLVMFLATQEVLRKRWTARLTIPAVLGALLVLMLGGITYTDMARYVVLVAAAFAEANSGGDVLHLALIAVFKIQPSFLVMNMLSARWTNQENVVLVLGAAFFQLASINVDLQIGVHGILNAAAIAWMIVRAITFPTTSTVAMPVLALLTPGMRALYLDTYRIILLVIGICSLLQERRKTMAKKKGAVLLGLALTSTGWFSPTTIAAGLMVCNPNKKRGWPATEFLSAVGLMFAIVGGLAELDIESMSIPFMLAGLMAVSYVVSGKATDMWLDRAADISWEMEAAITGSSRRLDVKLDDDGDFHLIDDPGVPWKVWLLRMSCIGLAALTPWAIVPAAFGYWLTLKTTKRGGVFWDTPSPKPCLKGDTTTGVYRIMARGILGTYQAGVGVMYENVFHTLWHTTRGAAIMSGEGKLTPYWGSINVKEDRISYGGPWRFDRKWNGTDDVQVIVVEPGKPAVNIQTKPGVFRTPFGEIGAVSLDYPRGTSGSPILDSNGDIIGLYGNGVELGDGSYVSAIVQGDRQEEPVPDAYTPGMLKKRQMTVLDLHPGSGKTRKILPQIIKDAIQQRLRTAVLAPTRVVAAEMAEALKGLPVRYQTSAVQREHQGNEIVDVMCHATLTHRLMSPNRVPNYNLFVMDEAHFTDPASIAARGYIATKVELGEAAAIFMTATPPGTTDPFPDSNAPIHDLQDEIPDRAWSSGYEWITDYAGKTVWFVASINVKMGNEIAMCLQRAGKKVIQLNRKSYDTEYPKCKNGDWDFVITTDISEMGANFGASRVIDCRKSINVKPTILEEGEGRVILGNPSPITSASAAQRRGRVGRNPNQVGDEYHYGGATSEDDSNLAHWTEAKIMLDNIHMPNGLVAQLYGPEREKAFTMDGEYRLRGEEKKNFLELLRTADLPVWLAYKVASNGIQYTDRKWCFDGPRTNAILEDNTEVEIVTRMGERKILKPRWLDARVYADHQALKWFKDFAAGKRSAVSFIEVLGRMPEHFMGKTREALDTMYLVATAEKGGKAHRMALEELPDALETITLIVAITVMTGGFFLLMMQRKGIGKMGLGALVLTLATFFLWAAEVPGTKIAGTLLVALLLMVVLIPEPEKQRSQTDNQLAVFLICVLTVVGVVAANEYGMLEKTKADLKSMFGGRTQASGLTGLPSMALDLRPATAWALYGGSTVVLTPLLKHLITSEYVTTSLASISSQAGSLFVLPRGVPFTDLDLTVGLVFLGCWGQITLTTFLTAMVLVTLHYGYMLPGWQAEALRAAQRRTAAGIMKNAVVDGMVATDVPELERTTPLMQKKVGQVLLIGVSINVAAFLVNPNVTTVREAGVLVTAATLTLWDNGASAVWNSTTATGLCHVMRGSYLAGGSIAWTLIKNADKPSLKRGRPGGRTLGEQWKEKLNAMSRDEFFKYRREAIIEVDRTEARRARRENNIVGGHPVSRGSAKLRWLVEKGFVSPIGKVIDLGCGRGGWSYYAATLKKVQEVKGYTKGGAGHEEPMLMQSYGWNLVSLKSGVDVFYKPSEPSDTLFCDIGESSPSPEVEEQRTLRVLEMTSDWLHRGPREFCIKVLCPYMPKVIEKMEVLQRRFGGGLVRLPLSRNSNHEMYWVSGAAGNVVHAVNMTSQVLLGRMDRTVWRGPKYEEDVNLGSGTRAVGKGEVHSNQEKIRKRIQKLKEEFATTWHKDPEHPYRTWTYHGSYEVKATGSASSLVNGVVKLMSKPWDAIANVTTMAMTDTTPFGQQRVFKEKVDTKAPEPPAGVKEVLNETTNWLWAHLSREKRPRLCTKEEFIKKVNSNAALGAVFAEQNQWSTAREAVGDPLFWEMVNEERENHLRGECHTCIYNMMGKREKKPGEFGKAKGSRAIWFMWLGARYLEFEALGFLNEDHWLSRENSGGGVEGSGVQKLGYILRDIAGKQGGKMYADDTAGWDTRITRTDLENEAKVLELLDGEHRMLARAIIELTYRHKVVKVMRPAAGGKTVMDVISREDQRGSGQVVTYALNTFTNIAVQLVRLMEAEGVIGPQHLEQLPRKNKIAVRTWLFENGEERVTRMAISGDDCVVKPLDDRFATALHFLNAMSKVRKDIQEWKPSHGWHDWQQVPFCSNHFQEIVMKDGRSIVVPCRGQDELIGRARISPGAGWNVKDTACLAKAYAQMWLLLYFHRRDLRLMANAICSAVPVDWVPTGRTSWSIHSKGEWMTTEDMLQVWNRVWIEENEWMMDKTPITSWTDVPYVGKREDIWCGSLIGTRSRATWAENVYAAINQVRAIIGKENYVDYMTSLRRYEDVLIQEDRVI

SEQ ID NO: 27 - protein, 3462 aa, Japanese encephalitis virus
MTKKPGGPGKNRAINMLKRGLPRVFPLVGVKRVVMSLLDGRGPVRFVLALITFFKFTALAPTKALLGRWRAVEKSINVAMKHLTSFKRELGTLIDAVNKRGKKQNKRGGNESSIMWLASLAIVAACAGAMKLSNFQGKLLMTINNTDIADVIVIPTSKGENRCWVRAIDVGYMCEDTITYECPKLAVGNDPEDVDCWCDNQEVYVQYGRCTRTRHSKRSRRSINVSINVQTHGESSLVNKKEAWLDSTKATRYLMKTENWIIRNPGYAFLAAALGWMLGSNSGQRVVFTILLLLVAPAYSFNCLGMGNRDFIEGASGATWVDLVLEGDSCLTIMANDKPTLDVRMINIEASQLAEVRSYCYHASINVTDISTVARCPTTGEAHNEKRADSSYVCKQGFTDRGWGNGCGLFGKGSIDTCAKFSCTNKAIGRMIQPENIKYEVGIFVHGTTTSENHGNYSAQVGASQAAKFTVTPNAPSITLKLGDYGEVTLDCEPRSGLNTEAFYVMTVGSKSFLVHREWFHDLSLPWTSPSSTAWRNRELLMEFEEAHATKQSINVVALGSQEGGLHQALAGAIVVEYSSSINVKLTSGHLKCRLKMDKLALKGTTYGMCTEKFSFAKNPADTGHGTVVIELTYSGSDGPCKIPIVSINVASLNDMTPVGRLVTVNPFVATSSSNSKVLVEMEPPFGDSYIVVGRGDKQINHHWHKAGSTLGKAFSTTLKGAQRLAALGDTAWDFGSIGGVFNSIGKAVHQVFGGAFRTLFGGMSWITQGLMGALLLWMGVNARDRSIALAFLATGGVLVFLATNVHADTGCAIDITRKEMRCGSGIFVHNDVEAWVDRYKYLPETPRSLAKIVHKAHQEGVCGVRSINVTRLEHQMWESINVRDELNVLLKENAVDLSINVVVNKPVGRYRSAPKRLSMTQEKFEMGWKAWGKSILFAPELANSTFVVDGPETKECPDERRAWNSMQIEDFGFGITSTRVWLKIREENTDECDGAIIGTAVKGHVAVHSDLSYWIESRLNDTWKLERAVFGEVKSCTWPETHTLWGDGVEESELIIPHTIAGPRSKHNRREGYKTQNQGPWDENGIVLDFDYCPGTKVTITEDCGKRGPSIRTTTDSGKLITDWCCRSCSLPPLRFRTENGCWYGMEIRPVRHDETTLVRSQVDAFNGEMIDPFQLGLLVMFLATQEVLRKRWTARLTIPAVLGALLVLMLGGITYTDLARYVVLVAAAFAEANSGGDVLHLALIAVFKIQPSFLVMNMLSARWTNQENVVLVLGAAFFQLASINVDLQIGVHGILNAAAIAWMIVRAITFPTTSTVAMPVLALLTPGMRALYLDTYRIILLVIGICSLLQERRKTMAKKKGAVLLGLALTSTGWFSPTTIAAGLMVCNPNKKRGWPATEFLSAVGLMFAIVGGLAELDIESMSIPFMLAGLMAVSYVVSGKATDMWLDRAADISWEMEAAITGSSRRLDVKLDDDGDFHLIDDPGVPWKVWLLRMSCIGLAALTPWAIVPAAFGYWLTLKTTKRGGVFWDTPSPKPCLKGDTTTGVYRIMARGILGTYQAGVGVMYENVFHTLWHTTRGAAIMSGEGKLTPYWGSINVKEDRISYGGPWRFDRKWNGTDDVQVIVVEPGKPAVNIQTKPGVFRTPFGEIGAVSLDYPRGTSGSPILDSNGDIIGLYGNGVELGDGSYVSAIVQGDRQEEPVPDAYTPSMLKKRQMTVLDLHPGSGKTRKILPQIIKDAIQQRLRTAVLAPTRVVAAEMAEALKGLPVRYQTSAVQREHQGNEIVDVMCHATLTHRLMSPNRVPNYNLFVMDEAHFTDPASIAARGYIATKVELGEAAAIFMTATPPGTTDPFPDSNAPIHDLQDEIPDRAWSSGYEWITDYAGKTVWFVASINVKMGNEIAMCLQRAGKKVIQLNRKSYDTEYPKCKNGDWDFVITADISEMGANFGASRVIDCRKSINVKPTILEEGEGRVILGNPSPITSASAAQRRGRVGRNPNQVGDEYHYGGATSEDDSNLAHWTEAKIMLDNIHMPNGLVAQLYGPEREKAFTMDGEYRLRGEEKKNFLELLRTADLPVWLAYKVASNGIQYTDRKWCFDGPRTNAILEDNTEVEIVTRMGERKILKPRWLDARVYADHQALKWFKDFAAGKRSAVSFIEVLGRMPEHFMGKTREALDTMYLVATAEKGGKAHRMALEELPDALETITLIVAITVMTGGFFLLMMQRKGIGKMGLGALVLTLATFFLWAAEVPGTKIAGTLLVALLLMVVLIPEPEKQRSQTDNQLAVFLICVLTVVGVVAANEYGMLEKTKADLKSMFGGRTQASGLTGLPSMALDLRPATAWALYGGSTVVLTPLLKHLITSEYVTTSLASISSQAGSLFVLPRGVPFTDLDLTVGLVFLGCWGQITLTTFLTAMVLVTLHYGYMLPGWQAEALRAAQRRTAAGIMKNAVVDGMVATDVPELERTTPLMQKKVGQVLLIGVSINVAAFLVNPNVTTVREAGVLVTAATLTLWDNGASAVWNSTTATGLCHVMRGSYLAGGSIAWTLIKNADKPSLKRGRPGGRTLGEQWKEKLNAMSRDEFFKYRREAIIEVDRTEARRARRENNIVGGHPVSRGSAKLRWLVEKGFVSPIGKVIDLGCGRGGWSYYAATLKKVQEVKGYTKGGAGHEEPMLMQSYGWNLVSLKSGVDVFYKPSEPSDTLFCDIGESSPSPEVEEQRTLRVLEMTSDWLHRGPREFCIKVLCPYMPKVIEKMEVLQRRFGGGLVRLPLSRNSNHEMYWVSGAAGNVVHAVNMTSQVLLGRMDRTVWRGPKYEEDVNLGSGTRAVGKGEVHSNQEKIRKRIQKLKEEFATTWHKDPEHPYRTWTYHGSYEVKATGSASSLVNGVVKLMSKPWDAIANVTTMAMTDTTPFGQQRVFKEKVDTKAPEPPAGVKEVLNETTNWLWAHLSREKRPRLCTKEEFIKKVNSNAALGAVFAEQNQWSTAREAVGDPLFWEMVNEERENHLRGECHTCIYNMMGKREKKPGEFGKAKGSRAIWFMWLGARYLEFEALGFLNEDHWLSRENSGGGVEGSGVQKLGYILRDIAGKQGGKMYADDTAGWDTRITRTDLENEAKVLELLDGEHRMLARAIIELTYRHKVVKVMRPAAGGKTVMDVISREDQRGSGQVVTYALNTFTNIAVQLVRLMEAEGVIGPQHLEQLPRKNKIAVRTWLFENGEERVARMAISGDDCVVKPLDDRFATALHFLNAMSKVRKDIQEWKPSHGWHDWQQVPFCSNHFQEIVMKDGRSIVVPCRGQDELIGRARISPGAGWNVKDTACLAKAYAQMWLLLYFHRRDLRLMANAICSAVPVDWVPTGRTSWSIHSKGEWMTTEDMLQVWNRVWIEENEWMMDKTPITSWTDVPYVGKREDIWCGSLIGTRSRATWAENVYAAINQVRAIIGKENYVDYMTSLRRYEDVLIQEDRVI

SEQ ID NO: 28 - protein, 3462 aa, Japanese encephalitis virus
MTKKPGGPGKNRAINMLKRGLPRVFPLVGVKRVVMSLLDGRGPVRFVLALVAFFKFTALAPTKALLGRWRAVEKSINVAMKHLTSFKRELGTLIDAVNKRGKKQNKRGGNESSIVWLASLAIVTACAGAMKLSNFQGKLLMTINNTDIADVIVIPTSKGENRCWVRAIDVGYMCEDTITYECPKLAVGNDPEDVDCWCDNQEVFVQYGRCTRTRHSKRSRRSINVSINVQTHGESSLVNKKEAWLDSTKATRYLMKTENWIIRNPGYAFLAAALGWMLGSNSGQRVVFTILLLLVAPAYSFNCLGMGNRDFIEGASGATWVDLVLEGDSCLTIMANDKPTLDVRMINIEASQLAEVRSYCYHASINVTDISTVARCPTTGEAHNEKRADSSYVCKQGFTDRGWGNGCGLFGKGSIDTCAKFSCTSKAIGRTIQPENIKYEVGVFVHGTTTSENHGNYSAQVGASQAAKFTVTPNAPSITLKLGDYGEVTLDCEPRSGLNTEAFYVMTVGSKSFLVHREWFHDLSLPWTSPSSTAWRNRELLMEFEEAHATKQSINVVALGSQEGGLHQALAGAIVVEYSSSINVKLTSGHLKCRLKMDKLALKGTTYGMCTEKFSFAKNPADTGHGTVVIELTYSGSDGPCKIPIVSINVASLNDMTPVGRLVTVNPFVATSSSNSKVLVEMEPPFGDSYIVVGRGDKQINHHWHKAGSTLGKAFSTTLKGAQRLAALGDTAWDFGSIGGVFNSIGKAVHQVFGGAFRTLFGGMSWITQGLMGALLLWMGVNARDRSIALAFLATGGVLVFLATNVHADTGCAIDITRKEMRCGSGIFVHNDVEAWVDRYKYLPETPRSLAKIVHKAHQEGVCGVRSINVTRLEHQMWESINVRDELNVLLKENAVDLSINVVVNKPVGRYRSAPKRLSMTQEKFEMGWKAWGKSILFAPELANSTFVVDGPETKECPDERRAWNSMQIEDFGFGITSTRVWLKIREEDTDECDGAIIGTAVKGHVAVHSDLSYWIESRFNDTWKLERAVFGEVKSCTWPETHTLWGDGVEESELIIPHTIAGPRSKHNRREGYKTQNQGPWDENGIVLDFDYCPGTKVTITEDCGKRGPSIRTTTDSGKLITDWCCRSCSLPPLRFRTENGCWYGMEIRPVRHDETTLVRSQVDAFNGEMIDPFQLGLLVMFLATQEVLRKRWTARLTIPAVLGALLVLMLGGITYTDLARYVVLVAAAFAEANSGGDVLHLALIAVFKIQPAFLVMNMLSARWTNQENMVLVLGAAFFQLASINVDLQIGVHGILNAAAIAWMIVRAITFPTTSTVTMPVLALLTPGMRALYLDTYRIILLVIGICSLLQERRKTMAKKKGAVLLGLALTSTGWFSPTTIAAGLMVCNPNKKRGWPATEFLSAVGLMFAIVGGLAELDIESMSIPFMLAGLMAVSYVVSGKATDMWLDRAADISWEMEAAITGSSRRLDVKLDDDGDFHLIDDPGVPWKVWLLRMSCIGLAALTPWAIVPAAFGYWLTLKTTKRGGVFWDTPSPKPCLKGDTTTGVYRIMARGILGTYQAGVGVMYENVFHTLWHTTRGAAIMSGEGKLTPYWGSINVKEDRISYGGPWRFDRKWNGTDDVQVIVVEPGKPAVNIQTKPGVFRTPFGEIGAVSLDYPRGTSGSPILDSNGDIIGLYGNGVELGDGSYVSAIVQGDRQEEPVPDAYTPSMLKKRQMTVLDLHPGSGKTRKILPQIIKDAIQQRLRTAVLAPTRVVAAEMAEALRGLPVRYQTSAVQREHQGNEIVDVMCHATLTHRLMSPNRVPNYNLFVMDEAHFTDPASIAARGYIATKVELGEAAAIFMTATPPGTTDPFPDSNAPIHDLQDEIPDRAWSSGYEWITEYAGKTVWFVASINVKMGNEIAMCLQRAGKKVIQLNRKSYDTEYPKCKNGDWDFVITTDISEMGANFGASRVIDCRKSINVKPTILEEGEGRVILGNPSPITSASAAQRRGRVGRNPNQVGDEYHYGGATSEDDSNLAHWTEAKIMLDNIHMPNGLVAQLYGPEREKAFTMDGEYRLRGEEKKNFLELLRTADLPVWLAYKVASNGIQYTDRKWCFDGPRTNAILEDNTEVEIVTRMGERKILKPRWLDARVYADHQALKWFKDFAAGKRSAVSFIEVLGRMPEHFMGKTREALDTMYLVATAEKGGKAHRMALEELPDALETITLIVAITVMTGGFFLLMMQRKGIGKMGLGALVLTLATFFLWAAEVPGTKIAGTLLVALLLMVVLIPEPEKQRSQTDNQLAVFLICVLTVVGVVAANEYGMLEKTKADLKSMFGGRTQAPGLTGLPSMALDLRPATAWALYGGSTVVLTPLLKHLITSEYVTTSLASISSQAGSLFVLPRGVPFTDLDLTVGLVFLGCWGQITLTTFLTAMVLVTLHYGYMLPGWQAEALRAAQRRTAAGIMKNAVVDGMVATDVPELERTTPLMQKKVGQVLLIGVSINVAAFLVNPNVTTVREAGVLVTAATLTLWDNGASAVWNSTTATGLCHVMRGSYLAGGSIAWTLIKNADKPSLKRGRPGGRTLGEQWKEKLNAMSRDEFFKYRREAIIEVDRTEARRARRENNIVGGHPVSRGSAKLRWLVEKGFVSPIGKVIDLGCGRGGWSYYAATLKKVQEVKGYTKGGAGHEEPMLMQSYGWNLVSLKSGVDVFYKPSEPSDTLFCDIGESSPSPEVEEQRTLRVLEMTSDWLHRGPREFCIKVLCPYMPKVIEKMEVLQRRFGGGLVRLPLSRNSNHEMYWVSGAAGNVVHAVNMTSQVLLGRMDRTVWRGPKYEEDVNLGSGTRAVGKGEVHSNQEKIRKRIQKLREEFATTWHKDPEHPYRTWTYHGSYEVKATGSASSLVNGVVKLMSKPWDAIANVTTMAMTDTTPFGQQRVFKEKVDTKAPEPPAGVKEVLNETTNWLWAHLSREKRPRLCTKEEFIKKVNSNAALGAVFAEQNQWSTAREAVGDPLFWEMVDEERENHLRGECHTCIYNMMGKREKKPGEFGKAKGSRAIWFMWLGARYLEFEALGFLNEDHWLSRENSGGGVEGSGVQKLGYILRDIAGKQGGKMYADDTAGWDTRITRTDLENEAKVLELLDGEHRMLARAIIELTYRHKVVKVMRPAAGGKTVMDVISREDQRGSGQVVTYALNTFTNIAVQLVRLMEAEGVIGPQHLEQLPRKNKIAVRTWLFENGEERVTRMAISGDDCVVKPLDDRFATALHFLNAMSKVRKDIQEWKPSHGWHDWQQVPFCSNHFQEIVMKDGRSIVVPCRGQDELIGRARISPGAGWNVKDTACLAKAYAQMWLLLYFHRRDLRLMANAICSAVPVDWVPTGRTSWSIHSKGEWMTTEDMLQVWNRVWIEENEWMTDKTPITSWTDVPYVGKREDIWCGSLIGTRSRATWAENIYAAINQVRAVIGKENYVDYMTSLRRYEDVLIQEDRVI

SEQ ID NO: 29 - protein, 3462 aa, Japanese encephalitis virus
MTKKPGGPGKNRAINMLKRGLPRVFPLVGVKRVVMSLLDGRGPVRFVLALITFFKFTALAPTKALLGRWRAVEKSINVAMKHLTSFKRELGTLIDAVNKRGKKQNKRGGNESSIMWLASLAIVTACAGAMKLSNFQGKLLMTINNTDIADVIVIPTSKGENRCWVRAIDVGYMCEDTITYECPKLAVGNDPEDVDCWCDNQEVFVQYGRCTRTRHSKRSRRSINVSINVQTHGESSLVNKKEAWLDSTKATRYLMKTENWIIRNPGYAFLAAALGWMLGSNSGQRVVFTILLLLVAPAYSFNCLGMGNRDFIEGASGATWVDLVLEGDSCLTIMANDKPTLDVRMINIEASQLAEVRSYCYHASINVTDISTVARCPTTGEAHNEKRADSSYVCKQGFTDRGWGNGCGLFGKGSIDTCAKFSCTSKAIGRTIQPENIKYEVGVFVHGTTTSENHGNYSAQVGASQAAKFTVTPNAPSITLKLGDYGEVTLDCEPRSGLNTEAFYVMTVGSKSFLVHREWFHDLSLPWTSPSSTAWRNRELLMEFEEAHATKQSINVVALGSQEGGLHQALAGAIVVEYSSSINVKLTSGHLKCRLKMDKLALKGTTYGMCTEKFSFAKNPADTGHGTVVIELTYSGSDGPCKIPIVSINVASLNDMTPVGRLVTVNPFVATSSSNSKVLVEMEPPFGDSYIVVGRGDKQINHHWHKAGSTLGKAFSTTLKGAQRLAALGDTAWDFGSIGGVFNSIGKAVHQVFGGAFRTLFGGMSWITQGLMGALLLWMGVNARDRSIALAFLATGGVLVFLATNVHADTGCAIDITRKEMRCGSGIFVHNDVEAWVDRYKYLPETPRSLAKIVHKAHQEGVCGVRSINVTRLEHQMWESINVRDELNVLLKENAVDLSINVVVNKPVGRYRSAPKRLSMTQEKFEMGWKAWGKSILFAPELANSTFVVDGPETKECPDERRAWNSMQIEDFGFGITSTRVWLKIREEDTDECDGAIIGTAVKGHVAVHSDLSYWIESRLNDTWKLERAVFGEVKSCTWPETHTLWGDGVEESELIIPHTIAGPKSKHNRREGYKTQNQGPWDENGIVLDFDYCPGTKVTITEDCGKRGPSIRTTTDSGKLITDWCCRSCSLPPLRFRTENGCWYGMEIRPVRHDETTLVRSQVDAFNGEMIDPFQLGLLVMFLATQEVLRKRWTARLTIPAVLGALLVLMLGGITYTDLARYVVLVAAAFAEANSGGDVLHLALIAVFKIQPAFLVMNMLSARWTNQENMVLVLGAAFFQLASINVDLQIGVHGILNAAAIAWMIVRAITFPTTSTVTMPVLALLTPGMRALYLDTYRIILLVIGTCSLLQERRKTMAKKKGAVLLGLALTSTGWFSPTTIAAGLMVCNPNKKRGWPATEFLSAVGLMFAIVGGLAELDIESMSIPFMLAGLMAVSYVVSGKATDMWLDRAADISWEMEAAITGSSRRLDVKLDDDGDFHLIDDPGVPWKVWLLRMSCIGLAALTPWAIVPAAFGYWLTLKTTKRGGVFWDTPSPKPCLKGDTTTGVYRIMARGILGTYQAGVGVMYENVFHTLWHTTRGAAIMSGEGKLTPYWGSINVKEDRISYGGPWRFDRKWNGTDDVQVIVVEPGKPAVNIQTKPGVFRTPFGEIGAVSLDYPRGTSGSPILDSNGDIIGLYGNGVELGDGSYVSAIVQGDRQEEPVPDAYTPSMLKKRQMTVLDLHPGSGKTRKILPQIIKDAIQQRLRTAVLAPTRVVAAEMAEALRGLPVRYQTSAVQREHQGNEIVDVMCHATLTHRLMSPNRVPNYNLFVMDEAHFTDPASIAARGYIATKVELGEAAAIFMTATPPGTTDPFPDSNAPIHDLQDEIPDRAWSSGYEWITEYAGKTVWFVASINVKMGNEIAMCLQRAGKKVIQLNRKSYDTEYPKCKNGDWDFVITTDISEMGANFGASRVIDCRKSINVKPTILEEGEGRVILGNPSPITSASAAQRRGRVGRNPNQVGDEYHYGGATSEDDSNLAHWTEAKIMLDNIHMPNGLVAQLYGPEREKAFTMDGEYRLRGEEKKNFLELLRTADLPVWLAYKVASNGIQYTDRKWCFDGPRTNAILEDNTEVEIVTRMGERKILKPRWLDARVYADHQALKWFKDFAAGKRSAVSFIEVLGRMPEHFMGKTREALDTMYLVATAEKGGKAHRMALEELPDALETITLIVAITVMTGGFFLLMMQRKGIGKMGLGALVLTLATFFLWAAEVPGTKIAGTLLVALLLMVVLIPEPEKQRSQTDNQLAVFLICVLTVVGVVAANEYGMLEKTKADLKSMFGGRTQAPGLTGLPSMALDLRPATAWALYGGSTVVLTPLLKHLITSEYVTTSLASISSQAGSLFVLPRGVPFTDLDLTVGLVFLGCWGQITLTTFLTAMVLVTLHYGYMLPGWQAEALRAAQRRTAAGIMKNAVVDGMVATDVPELERTTPLMQKKVGQVLLIGVSINVAAFLVNPNVTTVREAGVLVTAATLTLWDNGASAVWNSTTATGLCHVMRGSYLAGGSIAWTLIKNADKPSLKRGRPGGRTLGEQWKEKLNAMSRDEFFKYRREAIIEVDRTEARRARRENNIVGGHPVSRGSAKLRWLVEKGFVSPIGKVIDLGCGRGGWSYYAATLKKVQEVKGYTKGGAGHEEPMLMQSYGWNLVSLKSGVDVFYKPSEPSDTLFCDIGESSPSPEVEEQRTLRVLEMTSDWLHRGPREFCIKVLCPYMPKVIEKMEVLQRRFGGGLVRLPLSRNSNHEMYWVSGAAGNVVHAVNMTSQVLLGRMDRTVWRGPKYEEDVNLGSGTRAVGKGEVHSNQEKIRKRIQKLREEFATTWHKDPEHPYRTWTYHGSYEVKATGSASSLVNGVVKLMSKPWDAIANVTTMAMTDTTPFGQQRVFKEKVDTKAPEPPAGVKEVLNETTNWLWAHLSREKRPRLCTKEEFIKKVNSNAALGAVFAEQNQWSTAREAVGDPLFWEMVDEERENHLRGECHTCIYNMMGKREKKPGEFGKAKGSRAIWFMWLGARYLEFEALGFLNEDHWLSRENSGGGVEGSGVQKLGYILRDIAGKQGGKMYADDTAGWDTRITRTDLENEAKVLELLDGEHRMLARAIIELTYRHKVVKVMRPAAGGKTVMDVISREDQRGSGQVVTYALNTFTNIAVQLVRLMEAEGVIGPQHLEQLPRKNKIAVRTWLFENGEERVTRMAISGDDCVVKPLDDRFATALHFLNAMSKVRKDIQEWKPSHGWHDWQQVPFCSNHFQEIVMKDGRSIVVPCRGQDELIGRARISPGAGWNVKDTACLAKAYAQMWLLLYFHRRDLRLMANAICSAVPVDWVPTGRTSWSIHSKGEWMTTEDMLQVWNRVWIEENEWMMDKTPITSWTDVPYVGKREDIWCGSLIGTRSRATWAENIYAAINQVRAVIGKENYVDYMISLRRYEDVLIQEDRVI

SEQ ID NO: 30 - DNA, 2049 bp, West Nile Virus
atgtggcttgtcagcttggcaatcgtaacagcttgtgccggagctatgaagctctctaacttccaagggaaggtgatgatgacggtaaatgctactgacgtcacagatgtcatcacgattccaacagctgctggaaagaacctatgcattgtcagagcaatggatgtgggatacatgtgcgatgatactatcacttatgaatgcccagtgctgtcggctggcaatgatccagaagacatcgactgttggtgcacaaagtcagcagtctacgtcaggtatggaagatgcaccaagacacgccactcaagacgcagtcggaggtcactgacagtgcagacacacggagaaagcactctagcgaacaagaagggggcttggatggacagcaccaaggccacaaggtatttggtaaaaacagaatcatggatcttgaggaaccctggatatgccctggtggcagccgtcattggttggatgcttgggagcaacaccatgcagagagttgtgtttgtcgtgctattgcttttggtggccccagcttacagcttcaactgccttggaatgagcaacagagacttcttggaaggagtgtctggagcaacatgggtggatttggttctcgaaggcgacagctgcgtgactatcatgtctaaggacaagcctaccatcgatgtgaagatgatgaatatggaggcggccaacctggcagaggtccgcagttattgctatttggctaccgtcagcgatctctccaccaaagctgcgtgcccgaccatgggagaagctcacaatgacaaacgtgctgacccagcttttgtgtgcagacaaggagtggtggacaggggctggggcaacggctgcggactatttggcaaaggaagcattgacacatgcgccaaatttgcctgctctaccaaggcaataggaagaaccatcttgaaagagaatatcaagtatgaagtggccatttttgtccatgggccaactactgtggagtcgcacggaaactactccacacaggctggagccactcaggcagggagattcagcatcactcctgcggcgccttcatacacactaaagcttggagaatatggagaggtgacagtggactgtgaaccacggtcagggattgacaccaatgcatactacgtgatgactgttggaacaaagacgttcttggtccatcgtgagtggttcatggacctcaacctcccttggagcagtgctggaagtactgtgtggaggaacagagagacgttaatggagtttgaggaaccgcacgccacgaagcagtctgtgatagcattgggctcacaagagggagctctgcatcaagctttggctggagccattcctgtggaattttcaagcaacactgtcaagttgacgtcgggtcatttgaagtgtagagtgaagatggaaaaattgcagttgaagggaacaacctatggcgtctgttcaaaggctttcaagtttcttgggactcccgcagacacaggtcacggcactgtggtgttggaattgcagtacactggcacggacggaccttgcaaagttcctatctcgtcagtggcttcattgaacgacctaacgccagtgggtagattggtcactgtcaacccttttgtttcagtggccacggccaacgctaaggtcctgattgaattggaaccaccctttggagactcatacatagtggtgggcagaggagaacaacagatcaatcatcattggcacaagtctggaagcagcattggcaaagcctttacaaccaccctcaaaggagcgcagagactagccgctctaggagacacagcttgggactttggatcagttggaggggtgttcacctcagttgggaaggctgtccatcaagtgttcggaggagcattccgctcactgttcggaggcatgtcctggataacgcaaggattgctgggggctctcttgttgtggatgggcatcaatgctcgtgataggtccatagctctcacgtttctcgcagttggaggagttctgctcttcctctccgtgaacgtgcatgct

SEQ ID NO: 31 - DNA, 1506 bp, West Nile Virus
atgttcaactgccttggaatgagcaacagagacttcttggaaggagtgtctggagcaacatgggtggatttggttctcgaaggcgacagctgcgtgactatcatgtctaaggacaagcctaccatcgatgtgaagatgatgaatatggaggcggccaacctggcagaggtccgcagttattgctatttggctaccgtcagcgatctctccaccaaagctgcgtgcccgaccatgggagaagctcacaatgacaaacgtgctgacccagcttttgtgtgcagacaaggagtggtggacaggggctggggcaacggctgcggactatttggcaaaggaagcattgacacatgcgccaaatttgcctgctctaccaaggcaataggaagaaccatcttgaaagagaatatcaagtatgaagtggccatttttgtccatgggccaactactgtggagtcgcacggaaactactccacacaggctggagccactcaggcagggagattcagcatcactcctgcggcgccttcatacacactaaagcttggagaatatggagaggtgacagtggactgtgaaccacggtcagggattgacaccaatgcatactacgtgatgactgttggaacaaagacgttcttggtccatcgtgagtggttcatggacctcaacctcccttggagcagtgctggaagtactgtgtggaggaacagagagacgttaatggagtttgaggaaccgcacgccacgaagcagtctgtgatagcattgggctcacaagagggagctctgcatcaagctttggctggagccattcctgtggaattttcaagcaacactgtcaagttgacgtcgggtcatttgaagtgtagagtgaagatggaaaaattgcagttgaagggaacaacctatggcgtctgttcaaaggctttcaagtttcttgggactcccgcagacacaggtcacggcactgtggtgttggaattgcagtacactggcacggacggaccttgcaaagttcctatctcgtcagtggcttcattgaacgacctaacgccagtgggtagattggtcactgtcaacccttttgtttcagtggccacggccaacgctaaggtcctgattgaattggaaccaccctttggagactcatacatagtggtgggcagaggagaacaacagatcaatcatcattggcacaagtctggaagcagcattggcaaagcctttacaaccaccctcaaaggagcgcagagactagccgctctaggagacacagcttgggactttggatcagttggaggggtgttcacctcagttgggaaggctgtccatcaagtgttcggaggagcattccgctcactgttcggaggcatgtcctggataacgcaaggattgctgggggctctcttgttgtggatgggcatcaatgctcgtgataggtccatagctctcacgtttctcgcagttggaggagttctgctcttcctctccgtgaacgtgcatgct

SEQ ID NO: 32 - DNA, 1778 bp, West Nile Virus
ggggaaataagagagaaaagaagagtaagaagaaatataagagccaccatgttcaactgccttggaatgagcaacagagacttcttggaaggagtgtctggagcaacatgggtggatttggttctcgaaggcgacagctgcgtgactatcatgtctaaggacaagcctaccatcgatgtgaagatgatgaatatggaggcggccaacctggcagaggtccgcagttattgctatttggctaccgtcagcgatctctccaccaaagctgcgtgcccgaccatgggagaagctcacaatgacaaacgtgctgacccagcttttgtgtgcagacaaggagtggtggacaggggctggggcaacggctgcggactatttggcaaaggaagcattgacacatgcgccaaatttgcctgctctaccaaggcaataggaagaaccatcttgaaagagaatatcaagtatgaagtggccatttttgtccatgggccaactactgtggagtcgcacggaaactactccacacaggctggagccactcaggcagggagattcagcatcactcctgcggcgccttcatacacactaaagcttggagaatatggagaggtgacagtggactgtgaaccacggtcagggattgacaccaatgcatactacgtgatgactgttggaacaaagacgttcttggtccatcgtgagtggttcatggacctcaacctcccttggagcagtgctggaagtactgtgtggaggaacagagagacgttaatggagtttgaggaaccgcacgccacgaagcagtctgtgatagcattgggctcacaagagggagctctgcatcaagctttggctggagccattcctgtggaattttcaagcaacactgtcaagttgacgtcgggtcatttgaagtgtagagtgaagatggaaaaattgcagttgaagggaacaacctatggcgtctgttcaaaggctttcaagtttcttgggactcccgcagacacaggtcacggcactgtggtgttggaattgcagtacactggcacggacggaccttgcaaagttcctatctcgtcagtggcttcattgaacgacctaacgccagtgggtagattggtcactgtcaacccttttgtttcagtggccacggccaacgctaaggtcctgattgaattggaaccaccctttggagactcatacatagtggtgggcagaggagaacaacagatcaatcatcattggcacaagtctggaagcagcattggcaaagcctttacaaccaccctcaaaggagcgcagagactagccgctctaggagacacagcttgggactttggatcagttggaggggtgttcacctcagttgggaaggctgtccatcaagtgttcggaggagcattccgctcactgttcggaggcatgtcctggataacgcaaggattgctgggggctctcttgttgtggatgggcatcaatgctcgtgataggtccatagctctcacgtttctcgcagttggaggagttctgctcttcctctccgtgaacgtgcatgcttgataataggctggagcctcggtggccatgcttcttgccccttgggcctccccccagcccctcctccccttcctgcacccgtacccccgtggtctttgaataaagtctgagtgggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatctag

SEQ ID NO: 33 - DNA, 1557 bp, West Nile Virus
atgcagagagttgtgtttgtcgtgctattgcttttggtggccccagcttacagcttcaactgccttggaatgagcaacagagacttcttggaaggagtgtctggagcaacatgggtggatttggttctcgaaggcgacagctgcgtgactatcatgtctaaggacaagcctaccatcgatgtgaagatgatgaatatggaggcggccaacctggcagaggtccgcagttattgctatttggctaccgtcagcgatctctccaccaaagctgcgtgcccgaccatgggagaagctcacaatgacaaacgtgctgacccagcttttgtgtgcagacaaggagtggtggacaggggctggggcaacggctgcggactatttggcaaaggaagcattgacacatgcgccaaatttgcctgctctaccaaggcaataggaagaaccatcttgaaagagaatatcaagtatgaagtggccatttttgtccatgggccaactactgtggagtcgcacggaaactactccacacaggctggagccactcaggcagggagattcagcatcactcctgcggcgccttcatacacactaaagcttggagaatatggagaggtgacagtggactgtgaaccacggtcagggattgacaccaatgcatactacgtgatgactgttggaacaaagacgttcttggtccatcgtgagtggttcatggacctcaacctcccttggagcagtgctggaagtactgtgtggaggaacagagagacgttaatggagtttgaggaaccgcacgccacgaagcagtctgtgatagcattgggctcacaagagggagctctgcatcaagctttggctggagccattcctgtggaattttcaagcaacactgtcaagttgacgtcgggtcatttgaagtgtagagtgaagatggaaaaattgcagttgaagggaacaacctatggcgtctgttcaaaggctttcaagtttcttgggactcccgcagacacaggtcacggcactgtggtgttggaattgcagtacactggcacggacggaccttgcaaagttcctatctcgtcagtggcttcattgaacgacctaacgccagtgggtagattggtcactgtcaacccttttgtttcagtggccacggccaacgctaaggtcctgattgaattggaaccaccctttggagactcatacatagtggtgggcagaggagaacaacagatcaatcatcattggcacaagtctggaagcagcattggcaaagcctttacaaccaccctcaaaggagcgcagagactagccgctctaggagacacagcttgggactttggatcagttggaggggtgttcacctcagttgggaaggctgtccatcaagtgttcggaggagcattccgctcactgttcggaggcatgtcctggataacgcaaggattgctgggggctctcttgttgtggatgggcatcaatgctcgtgataggtccatagctctcacgtttctcgcagttggaggagttctgctcttcctctccgtgaacgtgcatgct

SEQ ID NO: 34 - DNA, 1829 bp, West Nile Virus
ggggaaataagagagaaaagaagagtaagaagaaatataagagccaccatgcagagagttgtgtttgtcgtgctattgcttttggtggccccagcttacagcttcaactgccttggaatgagcaacagagacttcttggaaggagtgtctggagcaacatgggtggatttggttctcgaaggcgacagctgcgtgactatcatgtctaaggacaagcctaccatcgatgtgaagatgatgaatatggaggcggccaacctggcagaggtccgcagttattgctatttggctaccgtcagcgatctctccaccaaagctgcgtgcccgaccatgggagaagctcacaatgacaaacgtgctgacccagcttttgtgtgcagacaaggagtggtggacaggggctggggcaacggctgcggactatttggcaaaggaagcattgacacatgcgccaaatttgcctgctctaccaaggcaataggaagaaccatcttgaaagagaatatcaagtatgaagtggccatttttgtccatgggccaactactgtggagtcgcacggaaactactccacacaggctggagccactcaggcagggagattcagcatcactcctgcggcgccttcatacacactaaagcttggagaatatggagaggtgacagtggactgtgaaccacggtcagggattgacaccaatgcatactacgtgatgactgttggaacaaagacgttcttggtccatcgtgagtggttcatggacctcaacctcccttggagcagtgctggaagtactgtgtggaggaacagagagacgttaatggagtttgaggaaccgcacgccacgaagcagtctgtgatagcattgggctcacaagagggagctctgcatcaagctttggctggagccattcctgtggaattttcaagcaacactgtcaagttgacgtcgggtcatttgaagtgtagagtgaagatggaaaaattgcagttgaagggaacaacctatggcgtctgttcaaaggctttcaagtttcttgggactcccgcagacacaggtcacggcactgtggtgttggaattgcagtacactggcacggacggaccttgcaaagttcctatctcgtcagtggcttcattgaacgacctaacgccagtgggtagattggtcactgtcaacccttttgtttcagtggccacggccaacgctaaggtcctgattgaattggaaccaccctttggagactcatacatagtggtgggcagaggagaacaacagatcaatcatcattggcacaagtctggaagcagcattggcaaagcctttacaaccaccctcaaaggagcgcagagactagccgctctaggagacacagcttgggactttggatcagttggaggggtgttcacctcagttgggaaggctgtccatcaagtgttcggaggagcattccgctcactgttcggaggcatgtcctggataacgcaaggattgctgggggctctcttgttgtggatgggcatcaatgctcgtgataggtccatagctctcacgtttctcgcagttggaggagttctgctcttcctctccgtgaacgtgcatgcttgataataggctggagcctcggtggccatgcttcttgccccttgggcctccccccagcccctcctccccttcctgcacccgtacccccgtggtctttgaataaagtctgagtgggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatctag

SEQ ID NO: 35 - RNA, 2049 nt, West Nile Virus
auguggcuugucagcuuggcaaucguaacagcuugugccggagcuaugaagcucucuaacuuccaagggaaggugaugaugacgguaaaugcuacugacgucacagaugucaucacgauuccaacagcugcuggaaagaaccuaugcauugucagagcaauggaugugggauacaugugcgaugauacuaucacuuaugaaugcccagugcugucggcuggcaaugauccagaagacaucgacuguuggugcacaaagucagcagucuacgucagguauggaagaugcaccaagacacgccacucaagacgcagucggaggucacugacagugcagacacacggagaaagcacucuagcgaacaagaagggggcuuggauggacagcaccaaggccacaagguauuugguaaaaacagaaucauggaucuugaggaacccuggauaugcccugguggcagccgucauugguuggaugcuugggagcaacaccaugcagagaguuguguuugucgugcuauugcuuuugguggccccagcuuacagcuucaacugccuuggaaugagcaacagagacuucuuggaaggagugucuggagcaacauggguggauuugguucucgaaggcgacagcugcgugacuaucaugucuaaggacaagccuaccaucgaugugaagaugaugaauauggaggcggccaaccuggcagagguccgcaguuauugcuauuuggcuaccgucagcgaucucuccaccaaagcugcgugcccgaccaugggagaagcucacaaugacaaacgugcugacccagcuuuugugugcagacaaggagugguggacaggggcuggggcaacggcugcggacuauuuggcaaaggaagcauugacacaugcgccaaauuugccugcucuaccaaggcaauaggaagaaccaucuugaaagagaauaucaaguaugaaguggccauuuuuguccaugggccaacuacuguggagucgcacggaaacuacuccacacaggcuggagccacucaggcagggagauucagcaucacuccugcggcgccuucauacacacuaaagcuuggagaauauggagaggugacaguggacugugaaccacggucagggauugacaccaaugcauacuacgugaugacuguuggaacaaagacguucuugguccaucgugagugguucauggaccucaaccucccuuggagcagugcuggaaguacuguguggaggaacagagagacguuaauggaguuugaggaaccgcacgccacgaagcagucugugauagcauugggcucacaagagggagcucugcaucaagcuuuggcuggagccauuccuguggaauuuucaagcaacacugucaaguugacgucgggucauuugaaguguagagugaagauggaaaaauugcaguugaagggaacaaccuauggcgucuguucaaaggcuuucaaguuucuugggacucccgcagacacaggucacggcacugugguguuggaauugcaguacacuggcacggacggaccuugcaaaguuccuaucucgucaguggcuucauugaacgaccuaacgccaguggguagauuggucacugucaacccuuuuguuucaguggccacggccaacgcuaagguccugauugaauuggaaccacccuuuggagacucauacauaguggugggcagaggagaacaacagaucaaucaucauuggcacaagucuggaagcagcauuggcaaagccuuuacaaccacccucaaaggagcgcagagacuagccgcucuaggagacacagcuugggacuuuggaucaguuggagggguguucaccucaguugggaaggcuguccaucaaguguucggaggagcauuccgcucacuguucggaggcauguccuggauaacgcaaggauugcugggggcucucuuguuguggaugggcaucaaugcucgugauagguccauagcucucacguuucucgcaguuggaggaguucugcucuuccucuccgugaacgugcaugcu

SEQ ID NO: 36 - RNA, 1506 nt, West Nile Virus
auguucaacugccuuggaaugagcaacagagacuucuuggaaggagugucuggagcaacauggguggauuugguucucgaaggcgacagcugcgugacuaucaugucuaaggacaagccuaccaucgaugugaagaugaugaauauggaggcggccaaccuggcagagguccgcaguuauugcuauuuggcuaccgucagcgaucucuccaccaaagcugcgugcccgaccaugggagaagcucacaaugacaaacgugcugacccagcuuuugugugcagacaaggagugguggacaggggcuggggcaacggcugcggacuauuuggcaaaggaagcauugacacaugcgccaaauuugccugcucuaccaaggcaauaggaagaaccaucuugaaagagaauaucaaguaugaaguggccauuuuuguccaugggccaacuacuguggagucgcacggaaacuacuccacacaggcuggagccacucaggcagggagauucagcaucacuccugcggcgccuucauacacacuaaagcuuggagaauauggagaggugacaguggacugugaaccacggucagggauugacaccaaugcauacuacgugaugacuguuggaacaaagacguucuugguccaucgugagugguucauggaccucaaccucccuuggagcagugcuggaaguacuguguggaggaacagagagacguuaauggaguuugaggaaccgcacgccacgaagcagucugugauagcauugggcucacaagagggagcucugcaucaagcuuuggcuggagccauuccuguggaauuuucaagcaacacugucaaguugacgucgggucauuugaaguguagagugaagauggaaaaauugcaguugaagggaacaaccuauggcgucuguucaaaggcuuucaaguuucuugggacucccgcagacacaggucacggcacugugguguuggaauugcaguacacuggcacggacggaccuugcaaaguuccuaucucgucaguggcuucauugaacgaccuaacgccaguggguagauuggucacugucaacccuuuuguuucaguggccacggccaacgcuaagguccugauugaauuggaaccacccuuuggagacucauacauaguggugggcagaggagaacaacagaucaaucaucauuggcacaagucuggaagcagcauuggcaaagccuuuacaaccacccucaaaggagcgcagagacuagccgcucuaggagacacagcuugggacuuuggaucaguuggagggguguucaccucaguugggaaggcuguccaucaaguguucggaggagcauuccgcucacuguucggaggcauguccuggauaacgcaaggauugcugggggcucucuuguuguggaugggcaucaaugcucgugauagguccauagcucucacguuucucgcaguuggaggaguucugcucuuccucuccgugaacgugcaugcu

SEQ ID NO: 37 - RNA, 1778 nt, West Nile Virus
ggggaaauaagagagaaaagaagaguaagaagaaauauaagagccaccauguucaacugccuuggaaugagcaacagagacuucuuggaaggagugucuggagcaacauggguggauuugguucucgaaggcgacagcugcgugacuaucaugucuaaggacaagccuaccaucgaugugaagaugaugaauauggaggcggccaaccuggcagagguccgcaguuauugcuauuuggcuaccgucagcgaucucuccaccaaagcugcgugcccgaccaugggagaagcucacaaugacaaacgugcugacccagcuuuugugugcagacaaggagugguggacaggggcuggggcaacggcugcggacuauuuggcaaaggaagcauugacacaugcgccaaauuugccugcucuaccaaggcaauaggaagaaccaucuugaaagagaauaucaaguaugaaguggccauuuuuguccaugggccaacuacuguggagucgcacggaaacuacuccacacaggcuggagccacucaggcagggagauucagcaucacuccugcggcgccuucauacacacuaaagcuuggagaauauggagaggugacaguggacugugaaccacggucagggauugacaccaaugcauacuacgugaugacuguuggaacaaagacguucuugguccaucgugagugguucauggaccucaaccucccuuggagcagugcuggaaguacuguguggaggaacagagagacguuaauggaguuugaggaaccgcacgccacgaagcagucugugauagcauugggcucacaagagggagcucugcaucaagcuuuggcuggagccauuccuguggaauuuucaagcaacacugucaaguugacgucgggucauuugaaguguagagugaagauggaaaaauugcaguugaagggaacaaccuauggcgucuguucaaaggcuuucaaguuucuugggacucccgcagacacaggucacggcacugugguguuggaauugcaguacacuggcacggacggaccuugcaaaguuccuaucucgucaguggcuucauugaacgaccuaacgccaguggguagauuggucacugucaacccuuuuguuucaguggccacggccaacgcuaagguccugauugaauuggaaccacccuuuggagacucauacauaguggugggcagaggagaacaacagaucaaucaucauuggcacaagucuggaagcagcauuggcaaagccuuuacaaccacccucaaaggagcgcagagacuagccgcucuaggagacacagcuugggacuuuggaucaguuggagggguguucaccucaguugggaaggcuguccaucaaguguucggaggagcauuccgcucacuguucggaggcauguccuggauaacgcaaggauugcugggggcucucuuguuguggaugggcaucaaugcucgugauagguccauagcucucacguuucucgcaguuggaggaguucugcucuuccucuccgugaacgugcaugcuugauaauaggcuggagccucgguggccaugcuucuugccccuugggccuccccccagccccuccuccccuuccugcacccguacccccguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 38 - RNA, 1557 nt, West Nile Virus
augcagagaguuguguuugucgugcuauugcuuuugguggccccagcuuacagcuucaacugccuuggaaugagcaacagagacuucuuggaaggagugucuggagcaacauggguggauuugguucucgaaggcgacagcugcgugacuaucaugucuaaggacaagccuaccaucgaugugaagaugaugaauauggaggcggccaaccuggcagagguccgcaguuauugcuauuuggcuaccgucagcgaucucuccaccaaagcugcgugcccgaccaugggagaagcucacaaugacaaacgugcugacccagcuuuugugugcagacaaggagugguggacaggggcuggggcaacggcugcggacuauuuggcaaaggaagcauugacacaugcgccaaauuugccugcucuaccaaggcaauaggaagaaccaucuugaaagagaauaucaaguaugaaguggccauuuuuguccaugggccaacuacuguggagucgcacggaaacuacuccacacaggcuggagccacucaggcagggagauucagcaucacuccugcggcgccuucauacacacuaaagcuuggagaauauggagaggugacaguggacugugaaccacggucagggauugacaccaaugcauacuacgugaugacuguuggaacaaagacguucuugguccaucgugagugguucauggaccucaaccucccuuggagcagugcuggaaguacuguguggaggaacagagagacguuaauggaguuugaggaaccgcacgccacgaagcagucugugauagcauugggcucacaagagggagcucugcaucaagcuuuggcuggagccauuccuguggaauuuucaagcaacacugucaaguugacgucgggucauuugaaguguagagugaagauggaaaaauugcaguugaagggaacaaccuauggcgucuguucaaaggcuuucaaguuucuugggacucccgcagacacaggucacggcacugugguguuggaauugcaguacacuggcacggacggaccuugcaaaguuccuaucucgucaguggcuucauugaacgaccuaacgccaguggguagauuggucacugucaacccuuuuguuucaguggccacggccaacgcuaagguccugauugaauuggaaccacccuuuggagacucauacauaguggugggcagaggagaacaacagaucaaucaucauuggcacaagucuggaagcagcauuggcaaagccuuuacaaccacccucaaaggagcgcagagacuagccgcucuaggagacacagcuugggacuuuggaucaguuggagggguguucaccucaguugggaaggcuguccaucaaguguucggaggagcauuccgcucacuguucggaggcauguccuggauaacgcaaggauugcugggggcucucuuguuguggaugggcaucaaugcucgugauagguccauagcucucacguuucucgcaguuggaggaguucugcucuuccucuccgugaacgugcaugcu

SEQ ID NO: 39 - RNA, 1829 nt, West Nile Virus
ggggaaauaagagagaaaagaagaguaagaagaaauauaagagccaccaugcagagaguuguguuugucgugcuauugcuuuugguggccccagcuuacagcuucaacugccuuggaaugagcaacagagacuucuuggaaggagugucuggagcaacauggguggauuugguucucgaaggcgacagcugcgugacuaucaugucuaaggacaagccuaccaucgaugugaagaugaugaauauggaggcggccaaccuggcagagguccgcaguuauugcuauuuggcuaccgucagcgaucucuccaccaaagcugcgugcccgaccaugggagaagcucacaaugacaaacgugcugacccagcuuuugugugcagacaaggagugguggacaggggcuggggcaacggcugcggacuauuuggcaaaggaagcauugacacaugcgccaaauuugccugcucuaccaaggcaauaggaagaaccaucuugaaagagaauaucaaguaugaaguggccauuuuuguccaugggccaacuacuguggagucgcacggaaacuacuccacacaggcuggagccacucaggcagggagauucagcaucacuccugcggcgccuucauacacacuaaagcuuggagaauauggagaggugacaguggacugugaaccacggucagggauugacaccaaugcauacuacgugaugacuguuggaacaaagacguucuugguccaucgugagugguucauggaccucaaccucccuuggagcagugcuggaaguacuguguggaggaacagagagacguuaauggaguuugaggaaccgcacgccacgaagcagucugugauagcauugggcucacaagagggagcucugcaucaagcuuuggcuggagccauuccuguggaauuuucaagcaacacugucaaguugacgucgggucauuugaaguguagagugaagauggaaaaauugcaguugaagggaacaaccuauggcgucuguucaaaggcuuucaaguuucuugggacucccgcagacacaggucacggcacugugguguuggaauugcaguacacuggcacggacggaccuugcaaaguuccuaucucgucaguggcuucauugaacgaccuaacgccaguggguagauuggucacugucaacccuuuuguuucaguggccacggccaacgcuaagguccugauugaauuggaaccacccuuuggagacucauacauaguggugggcagaggagaacaacagaucaaucaucauuggcacaagucuggaagcagcauuggcaaagccuuuacaaccacccucaaaggagcgcagagacuagccgcucuaggagacacagcuugggacuuuggaucaguuggagggguguucaccucaguugggaaggcuguccaucaaguguucggaggagcauuccgcucacuguucggaggcauguccuggauaacgcaaggauugcugggggcucucuuguuguggaugggcaucaaugcucgugauagguccauagcucucacguuucucgcaguuggaggaguucugcucuuccucuccgugaacgugcaugcuugauaauaggcuggagccucgguggccaugcuucuugccccuugggccuccccccagccccuccuccccuuccugcacccguacccccguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 40 - DNA, 92 bp, Artificial Sequence
  Synthetic Polynucleotide
tcaagcttttggaccctcgtacagaagctaatacgactcactatagggaaataagagagaaaagaagagtaagaagaaatataagagccacc

SEQ ID NO: 41 - DNA, 119 bp, Artificial Sequence
  Synthetic Polynucleotide
tgataataggctggagcctcggtggccatgcttcttgccccttgggcctccccccagcccctcctccccttcctgcacccgtacccccgtggtctttgaataaagtctgagtgggcggc

SEQ ID NO: 42 - RNA, 92 nt, Artificial Sequence
  Synthetic Polynucleotide
ucaagcuuuuggacccucguacagaagcuaauacgacucacuauagggaaauaagagagaaaagaagaguaagaagaaauauaagagccacc

SEQ ID NO: 43 - RNA, 119 nt, Artificial Sequence
  Synthetic Polynucleotide
ugauaauaggcuggagccucgguggccaugcuucuugccccuugggccuccccccagccccuccuccccuuccugcacccguacccccguggucuuugaauaaagucugagugggcggc

SEQ ID NO: 44 - protein, 514 aa, West Nile Virus
MFNCLGMSNRDFLEGVSGATWVDLVLEGDSCVTIMSKDKPTIDVKMMNMEAANLAEVRSYCYLATVSDLSTKAACPTMGEAHNDKRADPAFVCRQGVVDRGWGNGCGLFGKGSIDTCAKFACSTKAIGRTILKENIKYEVAIFVHGPTTVESHGNYSTQAGATQAGRFSITPAAPSYTLKLGEYGEVTVDCEPRSGIDTNAYYVMTVGTKTFLVHREWFMDLNLPWSSAGSTVWRNRETLMEFEEPHATKQSINVIALGSQEGALHQALAGAIPVEFSSNTVKLTSGHLKCRVKMEKLQLKGTTYGVCSKAFKFLGTPADTGHGTVVLELQYTGTDGPCKVPISSINVASLNDLTPVGRLVTVNPFVSINVATANAKVLIELEPPFGDSYIVVGRGEQQINHHWHKSGSSIGKAFTTTLKGAQRLAALGDTAWDFGSINVGGVFTSINVGKAVHQVFGGAFRSLFGGMSWITQGLLGALLLWMGINARDRSIALTFLAVGGVLLFLSINVNVHA

SEQ ID NO: 45 - protein, 531 aa, West Nile Virus
MQRVVFVVLLLLVAPAYSFNCLGMSNRDFLEGVSGATWVDLVLEGDSCVTIMSKDKPTIDVKMMNMEAANLAEVRSYCYLATVSDLSTKAACPTMGEAHNDKRADPAFVCRQGVVDRGWGNGCGLFGKGSIDTCAKFACSTKAIGRTILKENIKYEVAIFVHGPTTVESHGNYSTQAGATQAGRFSITPAAPSYTLKLGEYGEVTVDCEPRSGIDTNAYYVMTVGTKTFLVHREWFMDLNLPWSSAGSTVWRNRETLMEFEEPHATKQSINVIALGSQEGALHQALAGAIPVEFSSNTVKLTSGHLKCRVKMEKLQLKGTTYGVCSKAFKFLGTPADTGHGTVVLELQYTGTDGPCKVPISSINVASLNDLTPVGRLVTVNPFVSINVATANAKVLIELEPPFGDSYIVVGRGEQQINHHWHKSGSSIGKAFTTTLKGAQRLAALGDTAWDFGSINVGGVFTSINVGKAVHQVFGGAFRSLFGGMSWITQGLLGALLLWMGINARDRSIALTFLAVGGVLLFLSINVNVHA

SEQ ID NO: 46 - protein, 695 aa, West Nile Virus
MWLVSLAIVTACAGAMKLSNFQGKVMMTVNATDVTDVITIPTAAGKNLCIVRAMDVGYMCDDTITYECPVLSAGNDPEDIDCWCTKSAVYVRYGRCTKTRHSRRSRRSLTVQTHGESTLANKKGAWMDSTKATRYLVKTESWILRNPGYALVAAVIGWMLGSNTMQRVVFVVLLLLVAPAYSFNCLGMSNRDFLEGVSGATWVDLVLEGDSCVTIMSKDKPTIDVKMMNMEAANLAEVRSYCYLATVSDLSTKAACPTMGEAHNDKRADPAFVCRQGVVDRGWGNGCGLFGKGSIDTCAKFACSTKAIGRTILKENIKYEVAIFVHGPTTVESHGNYSTQAGATQAGRFSITPAAPSYTLKLGEYGEVTVDCEPRSGIDTNAYYVMTVGTKTFLVHREWFMDLNLPWSSAGSTVWRNRETLMEFEEPHATKQSINVIALGSQEGALHQALAGAIPVEFSSNTVKLTSGHLKCRVKMEKLQLKGTTYGVCSKAFKFLGTPADTGHGTVVLELQYTGTDGPCKVPISSINVASLNDLTPVGRLVTVNPFVSINVATANAKVLIELEPPFGDSYIVVGRGEQQINHHWHKSGSSIGKAFTTTLKGAQRLAALGDTAWDFGSINVGGVFTSINVGKAVHQVFGGAFRSLFGGMSWITQGLLGALLLWMGINARDRSIALTFLAVGGVLLFLSINVNVHA

SEQ ID NO: 47 - protein, 514 aa, West Nile Virus; identical to SEQ ID NO: 44

SEQ ID NO: 48 - DNA, 2586 bp, Eastern equine encephalitis virus
atggatttggacactcatttcacccagtataagttggcacgcccgtatattgctgattgccctaactgtgggcatagtcggtgcgacagccctatagctatagaagaagtcagaggggatgcgcacgcaggagtcatccgcatccagacatcagctatgttcggtctgaagacggatggagtcgatttggcctacatgagtttcatgaacggcaaaacgcagaaatcaataaagatcgacaacctgcatgtgcgcacctcagccccttgttccctcgtgtcgcaccacggctattacatcctggctcaatgcccaccaggggacacggttacagttgggtttcacgacgggcctaaccgccatacgtgcacagttgcccataaggtagaattcaggccagtgggtagagagaaataccgtcacccacctgaacatggagttgaattaccgtgtaaccgttacactcacaagcgtgcagaccaaggacactatgttgagatgcatcaacccgggctagttgccgaccactctctccttagcatccacagtgccaaggtgaaaattacggtaccgagcggcgcccaagtgaaatactactgcaagtgcccagatgtacgagagggaattaccagcagcgaccatacaaccacctgcacggatgtcaaacaatgcagggcttacctgattgacaacaaaaaatgggtgtacaactctggaagactgcctcgaggagagggcgacacttttaaaggaaaacttcatgtgccctttgtgcctgttaaggccaagtgcatcgccacgctggcaccggagcctctagttgagcacaaacaccgcaccctgattttacacctgcacccggaccatccgaccttgctgacgaccaggtcacttggaagtgatgcaaatccaactcgacaatggattgagcgaccaacaactgtcaatttcacagtcaccggagaagggttggagtatacctggggaaaccatccaccaaaaagagtatgggctcaagagtcaggagaagggaatccacatggatggccgcacgaagtggtagtctattactacaacaggtacccgttaaccacaattatcggattatgcacctgtgtggctatcattatggtctcttgtgtcacatccgtgtggctcctttgcaggactcgcaatctttgcataaccccgtataaactagccccgaacgctcaagtcccaatactcctggcgttactctgctgcattaagccgacgagggcatacgaacacacagcagtgatgccgaacaaggtggggatcccgtataaagctttagtcgaacgcccaggttatgcacccgttcacctacagatacagctggttaataccaggataattccatcaaccaacctggagtacatcacctgcaagtacaagacaaaagtgccttctccagtagtgaaatgctgcggtgccactcaatgtacctccaaaccccatcctgactatcagtgtcaggtgtttacaggtgtttacccattcatgtggggaggagcctactgcttctgtgacaccgaaaacacccagatgagcgaggcgtatgtagagcgctcggaagagtgctctattgaccacgcaaaagcttataaagtacacacaggcactgttcaggcaatggtgaacataacttatgggagcgtcagctggagatctgcagatgtctacgtcaatggtgaaactcccgcgaaaataggagatgccaaactcatcataggtccactgtcatctgcgtggtccccattcgataacaaggtggtggtttatgggcatgaagtgtataattacgactttcctgagtacggcaccggcaaagcaggctcttttggagacctgcaatcacgcacatcaaccagcaacgatctgtacgcaaacaccaacttgaagctacaacgaccccaggctggtatcgtacacacacctttcacccaggcgccctctggcttcgaacgatggaaaagggacaaaggggcaccgttgaacgacgtagccccgtttggctgttcgattgccctggagccgctccgtgcagaaaattgtgcagtgggaagcatccctatatctatagatatacccgatgcggctttcaccagaatatctgaaacaccgacagtctcagacctggaatgcaaaattacggagtgtacttatgcctccgacttcggtggtatagccaccgttgcctacaaatccagtaaagcaggaaactgtccaattcattctccatcaggtgttgcagttattaaagagaatgacgttactcttgctgagagcggatcatttacattccacttctccactgcaaacatccatcctgcttttaagctgcaggtctgcactagtgcagttacctgcaaaggagattgtaagccaccgaaagaccacatcgtcgattatccagcacaacataccgaatcctttacgtcggcgatatccgccaccgcgtggtcgtggctaaaagtgctggtaggaggaacatcagcattcattgttctggggcttattgctacagcagtggttgccctagttttgttcttccatagacat

SEQ ID NO: 49 - DNA, 2637 bp, Eastern equine encephalitis virus
atgcagagagttgtgtttgtcgtgctattgcttttggtggccccagcttacagcgatttggacactcatttcacccagtataagttggcacgcccgtatattgctgattgccctaactgtgggcatagtcggtgcgacagccctatagctatagaagaagtcagaggggatgcgcacgcaggagtcatccgcatccagacatcagctatgttcggtctgaagacggatggagtcgatttggcctacatgagtttcatgaacggcaaaacgcagaaatcaataaagatcgacaacctgcatgtgcgcacctcagccccttgttccctcgtgtcgcaccacggctattacatcctggctcaatgcccaccaggggacacggttacagttgggtttcacgacgggcctaaccgccatacgtgcacagttgcccataaggtagaattcaggccagtgggtagagagaaataccgtcacccacctgaacatggagttgaattaccgtgtaaccgttacactcacaagcgtgcagaccaaggacactatgttgagatgcatcaacccgggctagttgccgaccactctctccttagcatccacagtgccaaggtgaaaattacggtaccgagcggcgcccaagtgaaatactactgcaagtgcccagatgtacgagagggaattaccagcagcgaccatacaaccacctgcacggatgtcaaacaatgcagggcttacctgattgacaacaaaaaatgggtgtacaactctggaagactgcctcgaggagagggcgacacttttaaaggaaaacttcatgtgccctttgtgcctgttaaggccaagtgcatcgccacgctggcaccggagcctctagttgagcacaaacaccgcaccctgattttacacctgcacccggaccatccgaccttgctgacgaccaggtcacttggaagtgatgcaaatccaactcgacaatggattgagcgaccaacaactgtcaatttcacagtcaccggagaagggttggagtatacctggggaaaccatccaccaaaaagagtatgggctcaagagtcaggagaagggaatccacatggatggccgcacgaagtggtagtctattactacaacaggtacccgttaaccacaattatcggattatgcacctgtgtggctatcattatggtctcttgtgtcacatccgtgtggctcctttgcaggactcgcaatctttgcataaccccgtataaactagccccgaacgctcaagtcccaatactcctggcgttactctgctgcattaagccgacgagggcatacgaacacacagcagtgatgccgaacaaggtggggatcccgtataaagctttagtcgaacgcccaggttatgcacccgttcacctacagatacagctggttaataccaggataattccatcaaccaacctggagtacatcacctgcaagtacaagacaaaagtgccttctccagtagtgaaatgctgcggtgccactcaatgtacctccaaaccccatcctgactatcagtgtcaggtgtttacaggtgtttacccattcatgtggggaggagcctactgcttctgtgacaccgaaaacacccagatgagcgaggcgtatgtagagcgctcggaagagtgctctattgaccacgcaaaagcttataaagtacacacaggcactgttcaggcaatggtgaacataacttatgggagcgtcagctggagatctgcagatgtctacgtcaatggtgaaactcccgcgaaaataggagatgccaaactcatcataggtccactgtcatctgcgtggtccccattcgataacaaggtggtggtttatgggcatgaagtgtataattacgactttcctgagtacggcaccggcaaagcaggctcttttggagacctgcaatcacgcacatcaaccagcaacgatctgtacgcaaacaccaacttgaagctacaacgaccccaggctggtatcgtacacacacctttcacccaggcgccctctggcttcgaacgatggaaaagggacaaaggggcaccgttgaacgacgtagccccgtttggctgttcgattgccctggagccgctccgtgcagaaaattgtgcagtgggaagcatccctatatctatagatatacccgatgcggctttcaccagaatatctgaaacaccgacagtctcagacctggaatgcaaaattacggagtgtacttatgcctccgacttcggtggtatagccaccgttgcctacaaatccagtaaagcaggaaactgtccaattcattctccatcaggtgttgcagttattaaagagaatgacgttactcttgctgagagcggatcatttacattccacttctccactgcaaacatccatcctgcttttaagctgcaggtctgcactagtgcagttacctgcaaaggagattgtaagccaccgaaagaccacatcgtcgattatccagcacaacataccgaatcctttacgtcggcgatatccgccaccgcgtggtcgtggctaaaagtgctggtaggaggaacatcagcattcattgttctggggcttattgctacagcagtggttgccctagttttgttcttccatagacat

SEQ ID NO: 50 - RNA, 2586 nt, Eastern equine encephalitis virus
auggauuuggacacucauuucacccaguauaaguuggcacgcccguauauugcugauugcccuaacugugggcauagucggugcgacagcccuauagcuauagaagaagucagaggggaugcgcacgcaggagucauccgcauccagacaucagcuauguucggucugaagacggauggagucgauuuggccuacaugaguuucaugaacggcaaaacgcagaaaucaauaaagaucgacaaccugcaugugcgcaccucagccccuuguucccucgugucgcaccacggcuauuacauccuggcucaaugcccaccaggggacacgguuacaguuggguuucacgacgggccuaaccgccauacgugcacaguugcccauaagguagaauucaggccaguggguagagagaaauaccgucacccaccugaacauggaguugaauuaccguguaaccguuacacucacaagcgugcagaccaaggacacuauguugagaugcaucaacccgggcuaguugccgaccacucucuccuuagcauccacagugccaaggugaaaauuacgguaccgagcggcgcccaagugaaauacuacugcaagugcccagauguacgagagggaauuaccagcagcgaccauacaaccaccugcacggaugucaaacaaugcagggcuuaccugauugacaacaaaaaauggguguacaacucuggaagacugccucgaggagagggcgacacuuuuaaaggaaaacuucaugugcccuuugugccuguuaaggccaagugcaucgccacgcuggcaccggagccucuaguugagcacaaacaccgcacccugauuuuacaccugcacccggaccauccgaccuugcugacgaccaggucacuuggaagugaugcaaauccaacucgacaauggauugagcgaccaacaacugucaauuucacagucaccggagaaggguuggaguauaccuggggaaaccauccaccaaaaagaguaugggcucaagagucaggagaagggaauccacauggauggccgcacgaagugguagucuauuacuacaacagguacccguuaaccacaauuaucggauuaugcaccuguguggcuaucauuauggucucuugugucacauccguguggcuccuuugcaggacucgcaaucuuugcauaaccccguauaaacuagccccgaacgcucaagucccaauacuccuggcguuacucugcugcauuaagccgacgagggcauacgaacacacagcagugaugccgaacaagguggggaucccguauaaagcuuuagucgaacgcccagguuaugcacccguucaccuacagauacagcugguuaauaccaggauaauuccaucaaccaaccuggaguacaucaccugcaaguacaagacaaaagugccuucuccaguagugaaaugcugcggugccacucaauguaccuccaaaccccauccugacuaucagugucagguguuuacagguguuuacccauucauguggggaggagccuacugcuucugugacaccgaaaacacccagaugagcgaggcguauguagagcgcucggaagagugcucuauugaccacgcaaaagcuuauaaaguacacacaggcacuguucaggcaauggugaacauaacuuaugggagcgucagcuggagaucugcagaugucuacgucaauggugaaacucccgcgaaaauaggagaugccaaacucaucauagguccacugucaucugcgugguccccauucgauaacaagguggugguuuaugggcaugaaguguauaauuacgacuuuccugaguacggcaccggcaaagcaggcucuuuuggagaccugcaaucacgcacaucaaccagcaacgaucuguacgcaaacaccaacuugaagcuacaacgaccccaggcugguaucguacacacaccuuucacccaggcgcccucuggcuucgaacgauggaaaagggacaaaggggcaccguugaacgacguagccccguuuggcuguucgauugcccuggagccgcuccgugcagaaaauugugcagugggaagcaucccuauaucuauagauauacccgaugcggcuuucaccagaauaucugaaacaccgacagucucagaccuggaaugcaaaauuacggaguguacuuaugccuccgacuucggugguauagccaccguugccuacaaauccaguaaagcaggaaacuguccaauucauucuccaucagguguugcaguuauuaaagagaaugacguuacucuugcugagagcggaucauuuacauuccacuucuccacugcaaacauccauccugcuuuuaagcugcaggucugcacuagugcaguuaccugcaaaggagauuguaagccaccgaaagaccacaucgucgauuauccagcacaacauaccgaauccuuuacgucggcgauauccgccaccgcguggucguggcuaaaagugcugguaggaggaacaucagcauucauuguucuggggcuuauugcuacagcagugguugcccuaguuuuguucuuccauagacau

SEQ ID NO: 51 - RNA, 2637 nt, Eastern equine encephalitis virus
augcagagaguuguguuugucgugcuauugcuuuugguggccccagcuuacagcgauuuggacacucauuucacccaguauaaguuggcacgcccguauauugcugauugcccuaacugugggcauagucggugcgacagcccuauagcuauagaagaagucagaggggaugcgcacgcaggagucauccgcauccagacaucagcuauguucggucugaagacggauggagucgauuuggccuacaugaguuucaugaacggcaaaacgcagaaaucaauaaagaucgacaaccugcaugugcgcaccucagccccuuguucccucgugucgcaccacggcuauuacauccuggcucaaugcccaccaggggacacgguuacaguuggguuucacgacgggccuaaccgccauacgugcacaguugcccauaagguagaauucaggccaguggguagagagaaauaccgucacccaccugaacauggaguugaauuaccguguaaccguuacacucacaagcgugcagaccaaggacacuauguugagaugcaucaacccgggcuaguugccgaccacucucuccuuagcauccacagugccaaggugaaaauuacgguaccgagcggcgcccaagugaaauacuacugcaagugcccagauguacgagagggaauuaccagcagcgaccauacaaccaccugcacggaugucaaacaaugcagggcuuaccugauugacaacaaaaaauggguguacaacucuggaagacugccucgaggagagggcgacacuuuuaaaggaaaacuucaugugcccuuugugccuguuaaggccaagugcaucgccacgcuggcaccggagccucuaguugagcacaaacaccgcacccugauuuuacaccugcacccggaccauccgaccuugcugacgaccaggucacuuggaagugaugcaaauccaacucgacaauggauugagcgaccaacaacugucaauuucacagucaccggagaaggguuggaguauaccuggggaaaccauccaccaaaaagaguaugggcucaagagucaggagaagggaauccacauggauggccgcacgaagugguagucuauuacuacaacagguacccguuaaccacaauuaucggauuaugcaccuguguggcuaucauuauggucucuugugucacauccguguggcuccuuugcaggacucgcaaucuuugcauaaccccguauaaacuagccccgaacgcucaagucccaauacuccuggcguuacucugcugcauuaagccgacgagggcauacgaacacacagcagugaugccgaacaagguggggaucccguauaaagcuuuagucgaacgcccagguuaugcacccguucaccuacagauacagcugguuaauaccaggauaauuccaucaaccaaccuggaguacaucaccugcaaguacaagacaaaagugccuucuccaguagugaaaugcugcggugccacucaauguaccuccaaaccccauccugacuaucagugucagguguuuacagguguuuacccauucauguggggaggagccuacugcuucugugacaccgaaaacacccagaugagcgaggcguauguagagcgcucggaagagugcucuauugaccacgcaaaagcuuauaaaguacacacaggcacuguucaggcaauggugaacauaacuuaugggagcgucagcuggagaucugcagaugucuacgucaauggugaaacucccgcgaaaauaggagaugccaaacucaucauagguccacugucaucugcgugguccccauucgauaacaagguggugguuuaugggcaugaaguguauaauuacgacuuuccugaguacggcaccggcaaagcaggcucuuuuggagaccugcaaucacgcacaucaaccagcaacgaucuguacgcaaacaccaacuugaagcuacaacgaccccaggcugguaucguacacacaccuuucacccaggcgcccucuggcuucgaacgauggaaaagggacaaaggggcaccguugaacgacguagccccguuuggcuguucgauugcccuggagccgcuccgugcagaaaauugugcagugggaagcaucccuauaucuauagauauacccgaugcggcuuucaccagaauaucugaaacaccgacagucucagaccuggaaugcaaaauuacggaguguacuuaugccuccgacuucggugguauagccaccguugccuacaaauccaguaaagcaggaaacuguccaauucauucuccaucagguguugcaguuauuaaagagaaugacguuacucuugcugagagcggaucauuuacauuccacuucuccacugcaaacauccauccugcuuuuaagcugcaggucugcacuagugcaguuaccugcaaaggagauuguaagccaccgaaagaccacaucgucgauuauccagcacaacauaccgaauccuuuacgucggcgauauccgccaccgcguggucguggcuaaaagugcugguaggaggaacaucagcauucauuguucuggggcuuauugcuacagcagugguugcccuaguuuuguucuuccauagacau

SEQ ID NO: 52 - protein, 866 aa, Eastern equine encephalitis virus
MDLDTHFTQYKLARPYIADCPNCGHSRCDSPIAIEEVRGDAHAGVIRIQTSAMFGLKTDGVDLAYMSFMNGKTQKSIKIDNLHVRTSAPCSLVSHHGYYILAQCPPGDTVTVGFHDGPNRHTCTVAHKVEFRPVGREKYRHPPEHGVELPCNRYTHKRADQGHYVEMHQPGLVADHSLLSIHSAKVKITVPSGAQVKYYCKCPDVREGITSSDHTTTCTDVKQCRAYLIDNKKWVYNSGRLPRGEGDTFKGKLHVPFVPVKAKCIATLAPEPLVEHKHRTLILHLHPDHPTLLTTRSLGSDANPTRQWIERPTTVNFTVTGEGLEYTWGNHPPKRVWAQESGEGNPHGWPHEVVVYYYNRYPLTTIIGLCTCVAIIMVSCVTSINVWLLCRTRNLCITPYKLAPNAQVPILLALLCCIKPTRAYEHTAVMPNKVGIPYKALVERPGYAPVHLQIQLVNTRIIPSTNLEYITCKYKTKVPSPVVKCCGATQCTSKPHPDYQCQVFTGVYPFMWGGAYCFCDTENTQMSEAYVERSEECSIDHAKAYKVHTGTVQAMVNITYGSINVSWRSADVYVNGETPAKIGDAKLIIGPLSSAWSPFDNKVVVYGHEVYNYDFPEYGTGKAGSFGDLQSRTSTSNDLYANTNLKLQRPQAGIVHTPFTQAPSGFERWKRDKGAPLNDVAPFGCSIALEPLRAENCAVGSIPISIDIPDAAFTRISETPTVSDLECKITECTYASDFGGIATVAYKSSKAGNCPIHSPSGVAVIKENDVTLAESGSFTFHFSTANIHPAFKLQVCTSAVTCKGDCKPPKDHIVDYPAQHTESFTSAISATAWSWLKVLVGGTSAFIVLGLIATAVVALVLFFHRH

SEQ ID NO: 53 - protein, 883 aa, Eastern equine encephalitis virus
MQRVVFVVLLLLVAPAYSDLDTHFTQYKLARPYIADCPNCGHSRCDSPIAIEEVRGDAHAGVIRIQTSAMFGLKTDGVDLAYMSFMNGKTQKSIKIDNLHVRTSAPCSLVSHHGYYILAQCPPGDTVTVGFHDGPNRHTCTVAHKVEFRPVGREKYRHPPEHGVELPCNRYTHKRADQGHYVEMHQPGLVADHSLLSIHSAKVKITVPSGAQVKYYCKCPDVREGITSSDHTTTCTDVKQCRAYLIDNKKWVYNSGRLPRGEGDTFKGKLHVPFVPVKAKCIATLAPEPLVEHKHRTLILHLHPDHPTLLTTRSLGSDANPTRQWIERPTTVNFTVTGEGLEYTWGNHPPKRVWAQESGEGNPHGWPHEVVVYYYNRYPLTTIIGLCTCVAIIMVSCVTSINVWLLCRTRNLCITPYKLAPNAQVPILLALLCCIKPTRAYEHTAVMPNKVGIPYKALVERPGYAPVHLQIQLVNTRIIPSTNLEYITCKYKTKVPSPVVKCCGATQCTSKPHPDYQCQVFTGVYPFMWGGAYCFCDTENTQMSEAYVERSEECSIDHAKAYKVHTGTVQAMVNITYGSINVSWRSADVYVNGETPAKIGDAKLIIGPLSSAWSPFDNKVVVYGHEVYNYDFPEYGTGKAGSFGDLQSRTSTSNDLYANTNLKLQRPQAGIVHTPFTQAPSGFERWKRDKGAPLNDVAPFGCSIALEPLRAENCAVGSIPISIDIPDAAFTRISETPTVSDLECKITECTYASDFGGIATVAYKSSKAGNCPIHSPSGVAVIKENDVTLAESGSFTFHFSTANIHPAFKLQVCTSAVTCKGDCKPPKDHIVDYPAQHTESFTSAISATAWSWLKVLVGGTSAFIVLGLIATAVVALVLFFHRH

SEQ ID NO: 54 - protein, 866 aa, Eastern equine encephalitis virus; identical to SEQ ID NO: 52

SEQ ID NO: 55 - DNA, 2586 bp, Sindbis Virus
atggatgtggacgctcactttacccagtataaattagcccgcccgtatatagccgactgcccaaattgcggtcatggcagatgtgacagtccgatcgctatcgaggacgtgcgcggagacgcgcacgccggttacatccgcatacagacatccgcaatgttcggcatgaagtcggaaggggttgatctggcttacatgagctatatgaacggaaaggttttaaaagccatcaagattgatagcctgtacgtccgtacatcagcaccttgttctctggtttcttatcacggatactacctcctcgcgcagtgcccaccaggagatactgtaacagtagggttcctagaaggtacccacaagtatatgtgtacagtagcgcaccaggtaaaatttaacccggtggggagagagaaatacagacatccaccagaacacggtgttgaactaccctgcaacaaatacacccataagcgtgccgatcaaggccattatgtagaaatgcaccaaccgggtatggtcgccgaccacactctgttgagcatgagcggcaccaaggtgaaagtcaccgcaccgagcagttcgcaagtgaaatattactgcaaatgtccagatcttcaagaaggaactaccagcggtgaacacacaacaacatgtaccgatgttaagcaatgccgagcgtatctgattgacaacaggaagtgggtgtacaactcaggaaaattacctagaggagaaggcgaaacctttaaaggcaaactccatgtaccatttgtacctgttgcggccacctgcacagcgacccttgctccagagcctctcgtcgagcacaagcaccgctccctgatcctccacttgcatccagagcaccccacgctattgacaacaagggcgctcggaagtcaagcacaaccgactaggcaatggatagaccgcccaaccaccgtcaacttcacagttaccggagaaggttttgaatatacctggggcaaccatcccccgaaaagagtatgggcccaagagtcaggagaaggcaacccgcacggctggcctcacgaggtggtaatctactactacaataggtacccgatgacaactatcgtgggattatgcacgtgtgccgctattattatggtgtcatgcgttacatctgtatggcttttatgccgcacccgtaacctttgcataacaccctacagattggcaccaaatgcccacgtacctctcttagtagcgttgctgtgctgcgttaaaccaactagagcatacgagcacacggctgtgatgtcgaacaaggtggggatcccttacaaagccctagttgaaaggccagggtacgcacccgtacatctccagatccagctggtaagcacaaaaataatccctacagcgaacttggaatacattacctgtaaatataagactaaggtgccttccccagtagtaaaatgttgcggatccacccaatgtacgtctaaacaatacccagactatcagtgccaagtcttcacgggagtctacccatttatgtggggaggagcctactgtttctgtgatactgaaaatacacaaatgagcgaagcgtatgtcgaacgctcagaagaatgctcagtggaccaggccaaagcctacaaagtacacacaggaacggtgcaggctgtagttaatatcacctacgggggcgtcagctggagatctgccgacgtctatgtcaacggagagacccctgccaaaataggtgatgctaaactaactataggccctctctcttccgcatggtcaccttttgactctaaagtcatagtgtacgggcacgaggtgtataactatgactttcccgaatacggtaccggcaaagccggttcgttcggagacttgcaatccaggacacttacaagtaaggacttgtactctaacaccaatttgaaactgcaacgtccccagccaggagtggtccacaccccatacacccaggcaccctcggggtttgaacgttggaagaaagatcgaggggcaccgctaaacgacgtcgctccttttggatgcaacatagccctggaaccactgcgtgctgagaactgtgcggtggggagtatccctctctccatcgacatacccgatgccgcttttaccaggatatcggagacaccgactgtctccgatctggaatgtaaaattactgagtgcacgtatgcgtcagattttgggggaatagctactatgtcgtataaagctagcaaggcaggaaactgccctattcattccccttcgggcattgcagtaattaaagagaacgatgttattctttctggaagcggctcgttcacgttccatttttcaacagcgagcatccacccagcgttcaagatgcaggtatgcaccagcgtagtcacctgcaaaggtgactgcaagccacctaaggaccatatcgtcgattacccagcccagcatactgagacgtttacatcagcagtttccgcaactgcatggtcatggctgaaagtgctagttgggggcacatccgtctttatcattcttgggctaatcgctacagcagtggttgccctggtgctattcacccacaaacac

SEQ ID NO: 56 - DNA, 2637 bp, Sindbis Virus
atgcagagagttgtgtttgtcgtgctattgcttttggtggccccagcttacagcgatgtggacgctcactttacccagtataaattagcccgcccgtatatagccgactgcccaaattgcggtcatggcagatgtgacagtccgatcgctatcgaggacgtgcgcggagacgcgcacgccggttacatccgcatacagacatccgcaatgttcggcatgaagtcggaaggggttgatctggcttacatgagctatatgaacggaaaggttttaaaagccatcaagattgatagcctgtacgtccgtacatcagcaccttgttctctggtttcttatcacggatactacctcctcgcgcagtgcccaccaggagatactgtaacagtagggttcctagaaggtacccacaagtatatgtgtacagtagcgcaccaggtaaaatttaacccggtggggagagagaaatacagacatccaccagaacacggtgttgaactaccctgcaacaaatacacccataagcgtgccgatcaaggccattatgtagaaatgcaccaaccgggtatggtcgccgaccacactctgttgagcatgagcggcaccaaggtgaaagtcaccgcaccgagcagttcgcaagtgaaatattactgcaaatgtccagatcttcaagaaggaactaccagcggtgaacacacaacaacatgtaccgatgttaagcaatgccgagcgtatctgattgacaacaggaagtgggtgtacaactcaggaaaattacctagaggagaaggcgaaacctttaaaggcaaactccatgtaccatttgtacctgttgcggccacctgcacagcgacccttgctccagagcctctcgtcgagcacaagcaccgctccctgatcctccacttgcatccagagcaccccacgctattgacaacaagggcgctcggaagtcaagcacaaccgactaggcaatggatagaccgcccaaccaccgtcaacttcacagttaccggagaaggttttgaatatacctggggcaaccatcccccgaaaagagtatgggcccaagagtcaggagaaggcaacccgcacggctggcctcacgaggtggtaatctactactacaataggtacccgatgacaactatcgtgggattatgcacgtgtgccgctattattatggtgtcatgcgttacatctgtatggcttttatgccgcacccgtaacctttgcataacaccctacagattggcaccaaatgcccacgtacctctcttagtagcgttgctgtgctgcgttaaaccaactagagcatacgagcacacggctgtgatgtcgaacaaggtggggatcccttacaaagccctagttgaaaggccagggtacgcacccgtacatctccagatccagctggtaagcacaaaaataatccctacagcgaacttggaatacattacctgtaaatataagactaaggtgccttccccagtagtaaaatgttgcggatccacccaatgtacgtctaaacaatacccagactatcagtgccaagtcttcacgggagtctacccatttatgtggggaggagcctactgtttctgtgatactgaaaatacacaaatgagcgaagcgtatgtcgaacgctcagaagaatgctcagtggaccaggccaaagcctacaaagtacacacaggaacggtgcaggctgtagttaatatcacctacgggggcgtcagctggagatctgccgacgtctatgtcaacggagagacccctgccaaaataggtgatgctaaactaactataggccctctctcttccgcatggtcaccttttgactctaaagtcatagtgtacgggcacgaggtgtataactatgactttcccgaatacggtaccggcaaagccggttcgttcggagacttgcaatccaggacacttacaagtaaggacttgtactctaacaccaatttgaaactgcaacgtccccagccaggagtggtccacaccccatacacccaggcaccctcggggtttgaacgttggaagaaagatcgaggggcaccgctaaacgacgtcgctccttttggatgcaacatagccctggaaccactgcgtgctgagaactgtgcggtggggagtatccctctctccatcgacatacccgatgccgcttttaccaggatatcggagacaccgactgtctccgatctggaatgtaaaattactgagtgcacgtatgcgtcagattttgggggaatagctactatgtcgtataaagctagcaaggcaggaaactgccctattcattccccttcgggcattgcagtaattaaagagaacgatgttattctttctggaagcggctcgttcacgttccatttttcaacagcgagcatccacccagcgttcaagatgcaggtatgcaccagcgtagtcacctgcaaaggtgactgcaagccacctaaggaccatatcgtcgattacccagcccagcatactgagacgtttacatcagcagtttccgcaactgcatggtcatggctgaaagtgctagttgggggcacatccgtctttatcattcttgggctaatcgctacagcagtggttgccctggtgctattcacccacaaacac

SEQ ID NO: 57 - RNA, 2586 nt, Sindbis Virus
auggauguggacgcucacuuuacccaguauaaauuagcccgcccguauauagccgacugcccaaauugcggucauggcagaugugacaguccgaucgcuaucgaggacgugcgcggagacgcgcacgccgguuacauccgcauacagacauccgcaauguucggcaugaagucggaagggguugaucuggcuuacaugagcuauaugaacggaaagguuuuaaaagccaucaagauugauagccuguacguccguacaucagcaccuuguucucugguuucuuaucacggauacuaccuccucgcgcagugcccaccaggagauacuguaacaguaggguuccuagaagguacccacaaguauauguguacaguagcgcaccagguaaaauuuaacccgguggggagagagaaauacagacauccaccagaacacgguguugaacuacccugcaacaaauacacccauaagcgugccgaucaaggccauuauguagaaaugcaccaaccggguauggucgccgaccacacucuguugagcaugagcggcaccaaggugaaagucaccgcaccgagcaguucgcaagugaaauauuacugcaaauguccagaucuucaagaaggaacuaccagcggugaacacacaacaacauguaccgauguuaagcaaugccgagcguaucugauugacaacaggaaguggguguacaacucaggaaaauuaccuagaggagaaggcgaaaccuuuaaaggcaaacuccauguaccauuuguaccuguugcggccaccugcacagcgacccuugcuccagagccucucgucgagcacaagcaccgcucccugauccuccacuugcauccagagcaccccacgcuauugacaacaagggcgcucggaagucaagcacaaccgacuaggcaauggauagaccgcccaaccaccgucaacuucacaguuaccggagaagguuuugaauauaccuggggcaaccaucccccgaaaagaguaugggcccaagagucaggagaaggcaacccgcacggcuggccucacgaggugguaaucuacuacuacaauagguacccgaugacaacuaucgugggauuaugcacgugugccgcuauuauuauggugucaugcguuacaucuguauggcuuuuaugccgcacccguaaccuuugcauaacacccuacagauuggcaccaaaugcccacguaccucucuuaguagcguugcugugcugcguuaaaccaacuagagcauacgagcacacggcugugaugucgaacaagguggggaucccuuacaaagcccuaguugaaaggccaggguacgcacccguacaucuccagauccagcugguaagcacaaaaauaaucccuacagcgaacuuggaauacauuaccuguaaauauaagacuaaggugccuuccccaguaguaaaauguugcggauccacccaauguacgucuaaacaauacccagacuaucagugccaagucuucacgggagucuacccauuuauguggggaggagccuacuguuucugugauacugaaaauacacaaaugagcgaagcguaugucgaacgcucagaagaaugcucaguggaccaggccaaagccuacaaaguacacacaggaacggugcaggcuguaguuaauaucaccuacgggggcgucagcuggagaucugccgacgucuaugucaacggagagaccccugccaaaauaggugaugcuaaacuaacuauaggcccucucucuuccgcauggucaccuuuugacucuaaagucauaguguacgggcacgagguguauaacuaugacuuucccgaauacgguaccggcaaagccgguucguucggagacuugcaauccaggacacuuacaaguaaggacuuguacucuaacaccaauuugaaacugcaacguccccagccaggagugguccacaccccauacacccaggcacccucgggguuugaacguuggaagaaagaucgaggggcaccgcuaaacgacgucgcuccuuuuggaugcaacauagcccuggaaccacugcgugcugagaacugugcgguggggaguaucccucucuccaucgacauacccgaugccgcuuuuaccaggauaucggagacaccgacugucuccgaucuggaauguaaaauuacugagugcacguaugcgucagauuuugggggaauagcuacuaugucguauaaagcuagcaaggcaggaaacugcccuauucauuccccuucgggcauugcaguaauuaaagagaacgauguuauucuuucuggaagcggcucguucacguuccauuuuucaacagcgagcauccacccagcguucaagaugcagguaugcaccagcguagucaccugcaaaggugacugcaagccaccuaaggaccauaucgucgauuacccagcccagcauacugagacguuuacaucagcaguuuccgcaacugcauggucauggcugaaagugcuaguugggggcacauccgucuuuaucauucuugggcuaaucgcuacagcagugguugcccuggugcuauucacccacaaacac

SEQ ID NO: 58 - RNA, 2637 nt, Sindbis Virus
augcagagaguuguguuugucgugcuauugcuuuugguggccccagcuuacagcgauguggacgcucacuuuacccaguauaaauuagcccgcccguauauagccgacugcccaaauugcggucauggcagaugugacaguccgaucgcuaucgaggacgugcgcggagacgcgcacgccgguuacauccgcauacagacauccgcaauguucggcaugaagucggaagggguugaucuggcuuacaugagcuauaugaacggaaagguuuuaaaagccaucaagauugauagccuguacguccguacaucagcaccuuguucucugguuucuuaucacggauacuaccuccucgcgcagugcccaccaggagauacuguaacaguaggguuccuagaagguacccacaaguauauguguacaguagcgcaccagguaaaauuuaacccgguggggagagagaaauacagacauccaccagaacacgguguugaacuacccugcaacaaauacacccauaagcgugccgaucaaggccauuauguagaaaugcaccaaccggguauggucgccgaccacacucuguugagcaugagcggcaccaaggugaaagucaccgcaccgagcaguucgcaagugaaauauuacugcaaauguccagaucuucaagaaggaacuaccagcggugaacacacaacaacauguaccgauguuaagcaaugccgagcguaucugauugacaacaggaaguggguguacaacucaggaaaauuaccuagaggagaaggcgaaaccuuuaaaggcaaacuccauguaccauuuguaccuguugcggccaccugcacagcgacccuugcuccagagccucucgucgagcacaagcaccgcucccugauccuccacuugcauccagagcaccccacgcuauugacaacaagggcgcucggaagucaagcacaaccgacuaggcaauggauagaccgcccaaccaccgucaacuucacaguuaccggagaagguuuugaauauaccuggggcaaccaucccccgaaaagaguaugggcccaagagucaggagaaggcaacccgcacggcuggccucacgaggugguaaucuacuacuacaauagguacccgaugacaacuaucgugggauuaugcacgugugccgcuauuauuauggugucaugcguuacaucuguauggcuuuuaugccgcacccguaaccuuugcauaacacccuacagauuggcaccaaaugcccacguaccucucuuaguagcguugcugugcugcguuaaaccaacuagagcauacgagcacacggcugugaugucgaacaagguggggaucccuuacaaagcccuaguugaaaggccaggguacgcacccguacaucuccagauccagcugguaagcacaaaaauaaucccuacagcgaacuuggaauacauuaccuguaaauauaagacuaaggugccuuccccaguaguaaaauguugcggauccacccaauguacgucuaaacaauacccagacuaucagugccaagucuucacgggagucuacccauuuauguggggaggagccuacuguuucugugauacugaaaauacacaaaugagcgaagcguaugucgaacgcucagaagaaugcucaguggaccaggccaaagccuacaaaguacacacaggaacggugcaggcuguaguuaauaucaccuacgggggcgucagcuggagaucugccgacgucuaugucaacggagagaccccugccaaaauaggugaugcuaaacuaacuauaggcccucucucuuccgcauggucaccuuuugacucuaaagucauaguguacgggcacgagguguauaacuaugacuuucccgaauacgguaccggcaaagccgguucguucggagacuugcaauccaggacacuuacaaguaaggacuuguacucuaacaccaauuugaaacugcaacguccccagccaggagugguccacaccccauacacccaggcacccucgggguuugaacguuggaagaaagaucgaggggcaccgcuaaacgacgucgcuccuuuuggaugcaacauagcccuggaaccacugcgugcugagaacugugcgguggggaguaucccucucuccaucgacauacccgaugccgcuuuuaccaggauaucggagacaccgacugucuccgaucuggaauguaaaauuacugagugcacguaugcgucagauuuugggggaauagcuacuaugucguauaaagcuagcaaggcaggaaacugcccuauucauuccccuucgggcauugcaguaauuaaagagaacgauguuauucuuucuggaagcggcucguucacguuccauuuuucaacagcgagcauccacccagcguucaagaugcagguaugcaccagcguagucaccugcaaaggugacugcaagccaccuaaggaccauaucgucgauuacccagcccagcauacugagacguuuacaucagcaguuuccgcaacugcauggucauggcugaaagugcuaguugggggcacauccgucuuuaucauucuugggcuaaucgcuacagcagugguugcccuggugcuauucacccacaaacac

SEQ ID NO: 59 - protein, 870 aa, Sindbis Virus
MDVDAHFTQYKLARPYIADCPNCGHGRCDSPIAIEDVRGDAHAGYIRIQTSAMFGMKSEGVDLAYMSYMNGKVLKAIKIDSLYVRTSAPCSLVSYHGYYLLAQCPPGDTVTVGFLEGTHKYMCTVAHQVKFNPVGREKYRHPPEHGVELPCNKYTHKRADQGHYVEMHQPGMVADHTLLSMSGTKVKVTAPSSSQVKYYCKCPDLQEGTTSGEHTTTCTDVKQCRAYLIDNRKWVYNSGKLPRGEGETFKGKLHVPFVPVAATCTATLAPEPLVEHKHRSLILHLHPEHPTLLTTRALGSQAQPTRQWIDRPTTVNFTVTGEGFEYTWGNHPPKRVWAQESGEGNPHGWPHEVVIYYYNRYPMTTIVGLCTCAAIIMVSCVTSINVWLLCRTRNLCITPYRLAPNAHVPLLVALLCCVKPTRAYEHTAVMSNKVGIPYKALVERPGYAPVHLQIQLVSTKIIPTANLEYITCKYKTKVPSPVVKCCGSTQCTSKQYPDYQCQVFTGVYPFMWGGAYCFCDTENTQMSEAYVERSEECSINVDQAKAYKVHTGTVQAVVNITYGGVSWRSADVYVNGETPAKIGDAKLTIGPLSSAWSPFDSKVIVYGHEVYNYDFPEYGTGKAGSFGDLQSRTLTSKDLYSNTNLKLQRPQPGVVHTPYTQAPSGFERWKKDRGAPLNDVAPFGCNIALEPLRAENCAVGSIPLSIDIPDAAFTRISETPTVSDLECKITECTYASDFGGIATMSYKASKAGNCPIHSPSGIAVIKENDVILSGSGSFTFHFSTASIHPAFKMQVCTSINVVTCKGDCKPPKDHIVDYPAQHTETFTSAVSATAWSWLKVLVGGTSINVFIILGLIATAVVALVLFTHKH

SEQ ID NO: 60 - protein, 887 aa, Sindbis Virus
MQRVVFVVLLLLVAPAYSDVDAHFTQYKLARPYIADCPNCGHGRCDSPIAIEDVRGDAHAGYIRIQTSAMFGMKSEGVDLAYMSYMNGKVLKAIKIDSLYVRTSAPCSLVSYHGYYLLAQCPPGDTVTVGFLEGTHKYMCTVAHQVKFNPVGREKYRHPPEHGVELPCNKYTHKRADQGHYVEMHQPGMVADHTLLSMSGTKVKVTAPSSSQVKYYCKCPDLQEGTTSGEHTTTCTDVKQCRAYLIDNRKWVYNSGKLPRGEGETFKGKLHVPFVPVAATCTATLAPEPLVEHKHRSLILHLHPEHPTLLTTRALGSQAQPTRQWIDRPTTVNFTVTGEGFEYTWGNHPPKRVWAQESGEGNPHGWPHEVVIYYYNRYPMTTIVGLCTCAAIIMVSCVTSINVWLLCRTRNLCITPYRLAPNAHVPLLVALLCCVKPTRAYEHTAVMSNKVGIPYKALVERPGYAPVHLQIQLVSTKIIPTANLEYITCKYKTKVPSPVVKCCGSTQCTSKQYPDYQCQVFTGVYPFMWGGAYCFCDTENTQMSEAYVERSEECSINVDQAKAYKVHTGTVQAVVNITYGGVSWRSADVYVNGETPAKIGDAKLTIGPLSSAWSPFDSKVIVYGHEVYNYDFPEYGTGKAGSFGDLQSRTLTSKDLYSNTNLKLQRPQPGVVHTPYTQAPSGFERWKKDRGAPLNDVAPFGCNIALEPLRAENCAVGSIPLSIDIPDAAFTRISETPTVSDLECKITECTYASDFGGIATMSYKASKAGNCPIHSPSGIAVIKENDVILSGSGSFTFHFSTASIHPAFKMQVCTSINVVTCKGDCKPPKDHIVDYPAQHTETFTSAVSATAWSWLKVLVGGTSINVFIILGLIATAVVALVLFTHKH

SEQ ID NO: 61 - protein, 139 aa, Sindbis Virus
KPPSGKNITYECKCGDYKTATVSINVRTEIAGCTAIKQCVAYKSDQTKWVFNSPDLIRHADHTAQGKLHLPFKPTLSTCLVPLAHEPTVTHGFKHISLHLDTDHPTLLTTRRLGEKPEPTSEWISGKTVRNFTVDRDGL

SEQ ID NO: 62 - protein, 887 aa, Sindbis Virus; identical to SEQ ID NO: 60

SEQ ID NO: 63 - protein, 870 aa, Sindbis Virus; identical to SEQ ID NO: 59

SEQ ID NO: 64 - protein, 1271 aa, Venezuelan equine encephalitis virus
MFPFQPMYPMQPMPYRNPFAAPRRPWFPRTDPFLAMQVQELTRSMANLTFKQRRDAPPEGPSAKKPKKEASQKQKGGGQGKKKKNQGKKKAKTGPPNPKAQNGNKKKTNKKPGKRQRMVMKLESDKTFPIMLEGKINGYACVVGGKLFRPMHVEGKIDNDVLAALKTKKASKYDLEYADVPQNMRADTFKYTHEKPQGYYSWHHGAVQYENGRFTVPKGVGAKGDSGRPILDNQGRVVAIVLGGVNEGSRTALSINVVMWNEKGVTVKYTPENCEQWSLVTTMCLLANVTFPCAQPPICYDRKPAETLAMLSINVNVDNPGYDELLEAAVKCPGRKRRSTEELFKEYKLTRPYMARCIRCAVGSCHSPIAIEAVKSDGHDGYVRLQTSSQYGLDSSGNLKGRTMRYDMHGTIKEIPLHQVSLHTSRPCHIVDGHGYFLLARCPAGDSITMEFKKDSINVTHSCSINVPYEVKFNPVGRELYTHPPEHGVEQACQVYAHDAQNRGAYVEMHLPGSEVDSSLVSLSGSSINVTVTPPVGTSALVECECGGTKISETINKTKQFSQCTKKEQCRAYRLQNDKWVYNSDKLPKAAGATLKGKLHVPFLLADGKCTVPLAPEPMITFGFRSINVSLKLHPKNPTYLTTRQLADEPHYTHELISEPAVRNFTVTEKGWEFVWGNHPPKRFWAQETAPGNPHGLPHEVITHYYHRYPMSTILGLSICAAIATVSINVAASTWLFCRSRVACLTPYRLTPNARIPFCLAVLCCARTARAETTWESLDHLWNNNQQMFWIQLLIPLAALIVVTRLLRCVCCVVPFLVMAGAAGAGAYEHATTMPSQAGISYNTIVNRAGYAPLPISITPTKIKLIPTVNLEYVTCHYKTGMDSPAIKCCGSQECTPTYRPDEQCKVFTGVYPFMWGGAYCFCDTENTQVSKAYVMKSDDCLADHAEAYKAHTASINVQAFLNITVGEHSIVTTVYVNGETPVNFNGVKLTAGPLSTAWTPFDRKIVQYAGEIYNYDFPEYGAGQPGAFGDIQSRTVSSSDLYANTNLVLQRPKAGAIHVPYTQAPSGFEQWKKDKAPSLKFTAPFGCEIYTNPIRAENCAVGSIPLAFDIPDALFTRVSETPTLSAAECTLNECVYSSDFGGIATVKYSASKSGKCAVHVPSGTATLKEAAVELTEQGSATIHFSTANIHPEFRLQICTSYVTCKGDCHPPKDHIVTHPQYHAQTFTAAVSKTAWTWLTSLLGGSAVIIIIGLVLATIVAMYVLTNQKHN

SEQ ID NO: 65 - DNA, 2031 bp, Yellow Fever Virus
atggaaacccctgcccagctgctgttcctgctgctgctgtggctgcctgataccaccggcgtgacactcgtgcggaagaacagatggctgctgctgaacgtgaccagcgaggacctgggcaagaccttctctgtgggcaccggcaactgcaccaccaacatcctggaagccaagtactggtgccccgacagcatggagtacaactgccccaacctgagccccagagaggaacccgacgacatcgactgctggtgctacggcgtggaaaacgtgcgggtggcctacggcaagtgcgatagcgccggcagaagcagaagaagcaggcgggccatcgacctgcccacccacgaaaaccacggcctgaaaacccggcaggaaaagtggatgaccggccggatgggcgagcggcagctgcagaaaatcgagagatggctcgtgcgcaaccccttcttcgccgtgaccgccctgacaatcgcctacctcgtgggcagcaacatgacccagagagtcgtgatcgccctgctggtgctggctgtgggccctgcctatagcgcccactgtatcggcatcaccgaccgggacttcatcgagggcgtgcacggcggaacatgggtgtccgctaccctggaacaggataagtgcgtgaccgtgatggcccccgacaagcccagcctggacatcagcctggaaaccgtggccattgacggacccgccgaggccagaaaagtgtgctacaacgccgtgctgacccacgtgaagatcaacgacaagtgccccagcaccggcgaagcccacctggccgaagagaacgagggcgacaacgcctgcaagcggacctacagcgatagaggctggggcaatggctgcggcctgtttggcaagggcagcatcgtggcctgcgccaagttcacctgtgccaagagcatgagcctgttcgaggtggaccagaccaagatccagtacgtgatccgggctcagctgcacgtgggcgccaagcaggaaaactggaacaccgacatcaagaccctgaagttcgacgccctgagcggctcccaggaagccgagtttaccggctatggcaaggccaccctggaatgccaggtgcagaccgccgtggacttcggcaacagctatatcgccgagatggaaaaagaaagctggatcgtggaccggcagtgggcccaggatctgacactgccttggcagtctggctctggcggagtgtggcgggaaatgcaccacctggtggaattcgagcctccccacgccgccaccattagagtgctggccctgggcaatcaggaaggctctctgaaaacagccctgaccggcgccatgagagtgaccaaggacaccaacgacaacaacctgtacaagctgcacggggggcacgtgtcctgcagagtgaaactgtctgccctgacactgaagggcaccagctacaagatgtgcaccgacaagatgagcttcgtgaagaaccccaccgacaccggccacggcacagtcgtgatgcaagtgaaggtgcccaagggcgctccctgcagaatccctgtgatcgtggccgatgatctgacagccgccatcaacaagggcatcctcgtgacagtgaaccctatcgcctccaccaacgatgacgaggtgctgatcgaagtgaacccccccttcggcgactcctacatcatcgtgggcacaggcgacagcagactgacctaccagtggcacaaagagggcagcagcatcggcaagctgttcacccagaccatgaagggcgccgagagactggctgtgatgggagatgccgcctgggactttagcagcgctggcggcttctttaccagcgtgggcaagggaatccacaccgtgttcggcagcgccttccagggactgtttggcggcctgagctggatcaccaaagtgatcatgggcgctgtgctgatctgggtgggaatcaacacccggaacatgaccatgagcatgtccatgatcctcgtgggagtgattatgatgttcctgagcctgggcgtgggagcc

SEQ ID NO: 66 - DNA, 2016 bp, Yellow Fever Virus
atgtggctggtgtccctggccatcgtgacagcctgtgctggcgctgtgacactcgtgcggaagaacagatggctgctgctgaacgtgaccagcgaggacctgggcaagaccttctctgtgggcaccggcaactgcaccaccaacatcctggaagccaagtactggtgccccgacagcatggagtacaactgccccaacctgagccccagagaggaacccgacgacatcgactgctggtgctacggcgtggaaaacgtgcgggtggcctacggcaagtgcgatagcgccggcagaagcagaagaagcaggcgggccatcgacctgcccacccacgaaaaccacggcctgaaaacccggcaggaaaagtggatgaccggccggatgggcgagcggcagctgcagaaaatcgagagatggctcgtgcgcaaccccttcttcgccgtgaccgccctgacaatcgcctacctcgtgggcagcaacatgacccagagagtcgtgatcgccctgctggtgctggctgtgggccctgcctatagcgcccactgtatcggcatcaccgaccgggacttcatcgagggcgtgcacggcggaacatgggtgtccgctaccctggaacaggataagtgcgtgaccgtgatggcccccgacaagcccagcctggacatcagcctggaaaccgtggccattgacggacccgccgaggccagaaaagtgtgctacaacgccgtgctgacccacgtgaagatcaacgacaagtgccccagcaccggcgaagcccacctggccgaagagaacgagggcgacaacgcctgcaagcggacctacagcgatagaggctggggcaatggctgcggcctgtttggcaagggcagcatcgtggcctgcgccaagttcacctgtgccaagagcatgagcctgttcgaggtggaccagaccaagatccagtacgtgatccgggcccagctgcacgtgggagccaagcaggaaaactggaacaccgacatcaagaccctgaagttcgacgccctgagcggctcccaggaagccgagtttaccggctatggcaaggccaccctggaatgccaggtgcagaccgccgtggacttcggcaacagctatatcgccgagatggaaaaagaaagctggatcgtggaccggcagtgggcccaggacctgacactgccttggcagtctggatctggcggcgtgtggcgggaaatgcaccacctggtggaattcgagcctccccatgccgccaccatcagagtgctggccctgggcaatcaggaaggctctctgaaaacagccctgaccggcgccatgagagtgaccaaggacaccaacgacaacaacctgtacaagctgcatggcggccacgtgtcctgcagagtgaagctgtctgccctgaccctgaaaggcaccagctacaagatgtgcaccgacaagatgagcttcgtgaagaaccccaccgacaccggccacggcacagtcgtgatgcaagtgaaggtgcccaagggcgctccctgcagaatccctgtgatcgtggccgatgatctgacagccgccatcaacaagggcatcctcgtgacagtgaaccctatcgcctccaccaacgatgacgaggtgctgatcgaagtgaacccccccttcggcgactcctacatcatcgtgggcacaggcgacagcagactgacctaccagtggcacaaagagggcagcagcatcggcaagctgttcacccagaccatgaagggcgccgagagactggctgtgatgggagatgccgcctgggactttagcagcgctggcggcttctttaccagcgtgggcaagggaatccacaccgtgttcggcagcgccttccagggactgtttggcggcctgagctggatcaccaaagtgatcatgggcgctgtgctgatctgggtgggaatcaacacccggaacatgaccatgagcatgtccatgatcctcgtgggagtgattatgatgttcctgagcctgggcgtgggcgcc

SEQ ID NO: 67 - DNA, 2016 bp, Yellow Fever Virus
atgtggctggtgtccctggccatcgtgacagcctgtgctggcgctgtgacactcgtgcggaagaacagatggctgctgctgaacgtgaccagcgaggacctgggcaagaccttctctgtgggcaccggcaactgcaccaccaacatcctggaagccaagtactggtgccccgacagcatggagtacaactgccccaacctgagccccagagaggaacccgacgacatcgactgctggtgctacggcgtggaaaacgtgcgggtggcctacggcaagtgcgatagcgccggcagaagcagaagaagcaggcgggccatcgacctgcccacccacgaaaaccacggcctgaaaacccggcaggaaaagtggatgaccggccggatgggcgagcggcagctgcagaaaatcgagagatggctcgtgcgcaaccccttcttcgccgtgaccgccctgacaatcgcctacctcgtgggcagcaacatgacccagagagtcgtgatcgccctgctggtgctggctgtgggccctgcctatagcgcccactgtatcggcatcaccgaccgggacttcatcgagggcgtgcacggcggaacatgggtgtccgctaccctggaacaggataagtgcgtgaccgtgatggcccccgacaagcccagcctggacatcagcctggaaaccgtggccattgacggacccgccgaggccagaaaagtgtgctacaacgccgtgctgacccacgtgaagatcaacgacaagtgccccagcaccggcgaagcccacctggccgaagagaacgagggcgacaacgcctgcaagcggacctacagcgatagaggctggggcaatggctgcggcctgtttggcaagggcagcatcgtggcctgcgccaagttcacctgtgccaagagcatgagcctgttcgaggtggaccagaccaagatccagtacgtgatccgggcccagctgcacgtgggagccaagcaggaaaactggaccaccgacatcaagaccctgaagttcgacgccctgagcggctcccaggaagccgagtttaccggctatggcaaggccaccctggaatgccaggtgcagaccgccgtggacttcggcaacagctatatcgccgagatggaaaaagaaagctggatcgtggaccggcagtgggcccaggacctgacactgccttggcagtctggatctggcggcgtgtggcgggaaatgcaccacctggtggaattcgagcctccccatgccgccaccatcagagtgctggccctgggcaatcaggaaggctctctgaaaacagccctgaccggcgccatgagagtgaccaaggacaccaacgacaacaacctgtacaagctgcatggcggccacgtgtcctgcagagtgaagctgtctgccctgaccctgaaaggcaccagctacaagatgtgcaccgacaagatgagcttcgtgaagaaccccaccgacaccggccacggcacagtcgtgatgcaagtgaaggtgcccaagggcgctccctgcagaatccctgtgatcgtggccgatgatctgacagccgccatcaacaagggcatcctcgtgacagtgaaccctatcgcctccaccaacgatgacgaggtgctgatcgaagtgaacccccccttcggcgactcctacatcatcgtgggcacaggcgacagcagactgacctaccagtggcacaaagagggcagcagcatcggcaagctgttcacccagaccatgaagggcgccgagagactggctgtgatgggagatgccgcctgggactttagcagcgctggcggcttctttaccagcgtgggcaagggaatccacaccgtgttcggcagcgccttccagggactgtttggcggcctgagctggatcaccaaagtgatcatgggcgctgtgctgatctgggtgggaatcaacacccggaacatgaccatgagcatgtccatgatcctcgtgggagtgattatgatgttcctgagcctgggcgtgggcgcc

SEQ ID NO: 68 - DNA, 2241 bp, Yellow Fever Virus
atgtggctggtgtccctggccatcgtgacagcctgtgctggcgctgtgacactcgtgcggaaaaacagatggctgctgctgaacgtgaccagcgaggacctgggcaagaccttctctgtaggcaccggcaactgcaccaccaacatcctggaagccaagtactggtgccccgacagcatggagtacaactgccccaacctgagccccagagaggaacccgacgacatcgactgctggtgctacggcgtggaaaacgtgcgggtggcctacggcaagtgcgatagcgccggcagaagcagaagaagcaggcgggccatcgacctgcccacccacgaaaaccacggcctgaaaacccggcaggaaaagtggatgaccggccggatgggcgagcggcagctgcagaaaattgagcggtggtttgtgcggaaccccttcttcgccgtgaccgccctgacaatcgcctacctcgtgggcagcaacatgacccagagagtcgtgatcgccctgctggtgctggctgtgggccctgcctatagcgccattgatctgcctacacacgagaatcatgggctgaaaacaagacaggaaaaatggatgactgggcgcatgggagaaagacagctgcagaaaatcgaacggtggttcgtgcgcaatcctttttttgctgtgactgctctgaccattgcctatctcgtgggatccaatatgacacagcgggtcgtgattgctctgctggtgctggcagtgggacccgcttactccgcccactgtatcggcatcaccgaccgggacttcatcgagggcgtgcacggcggaacatgggtgtccgctaccctggaacaggataagtgcgtgaccgtgatggcccccgacaagcccagcctggacatcagcctggaaaccgtggccatcgatagacccgccgaagtgcggaaagtgtgctacaacgccgtgctgacccacgtgaagatcaacgacaagtgccccagcaccggcgaagcccacctggccgaagagaacgagggcgacaacgcctgcaagcggacctacagcgatagaggctggggcaatggctgcggcctgtttggcaagggcagcatcgtggcctgcgccaagttcacctgtgccaagagcatgagcctgttcgaggtggaccagaccaagatccagtacgtgatccgggcccagctgcacgtgggagccaagcaggaaaactggaacaccgacatcaagaccctgaagttcgacgccctgagcggctcccaggaagtggaattcatcggctatggcaaggccaccctggaatgtcaggtgcagaccgccgtggacttcggcaacagctatatcgccgagatggaaaccgagagctggatcgtggaccggcagtgggctcaggatctgaccctgccttggcagtctggctctggcggagtgtggcgggaaatgcaccacctggtggaattcgagcctccccacgccgccaccattagagtgctggccctgggcaatcaggaaggctctctgaaaacagccctgaccggcgccatgagagtgaccaaggacaccaacgacaacaacctgtacaagctgcatggcggccacgtgtcctgcagagtgaagctgtctgccctgacactgaagggcaccagctacaagatctgcaccgacaagatgttcttcgtgaagaaccccaccgacaccggccacggcacagtcgtgatgcaagtgaaggtgtccaagggcgctccctgccggatccctgtgatcgtggccgatgatctgacagccgccatcaacaagggcatcctcgtgacagtgaaccctatcgcctccaccaacgatgacgaggtgctgatcgaagtgaacccccccttcggcgactcctacatcatcgtgggacggggcgacagcagactgacctaccagtggcacaaagagggcagcagcatcggcaagctgttcacccagaccatgaagggcgtggaacggctggccgtgatgggagataccgcctgggatttctctagcgctggcggcttcttcaccagcgtgggcaagggaatccacaccgtgttcggcagcgccttccagggactgttcggcggcctgaactggatcaccaaagtgatcatgggcgctgtgctgatctgggtgggaatcaacacccggaacatgaccatgagcatgtccatgatcctcgtgggagtgattatgatgttcctgagcctgggtgtgggcgcc

SEQ ID NO: 69 - DNA, 2256 bp, Yellow Fever Virus
atggaaacccctgcccagctgctgttcctgctgctgctgtggctgcctgataccaccggcgtgacactcgtgcggaagaacagatggctgctgctgaacgtgaccagcgaggacctgggcaagaccttctctgtgggcaccggcaactgcaccaccaacatcctggaagccaagtactggtgccccgacagcatggagtacaactgccccaacctgagccccagagaggaacccgacgacatcgactgctggtgctacggcgtggaaaacgtgcgggtggcctacggcaagtgcgatagcgccggcagaagcagaagaagcaggcgggccatcgacctgcccacccacgaaaaccacggcctgaaaacccggcaggaaaagtggatgaccggccggatgggcgagcggcagctgcagaaaattgagcggtggtttgtgcggaaccccttcttcgccgtgaccgccctgacaatcgcctacctcgtgggcagcaacatgacccagagagtcgtgatcgccctgctggtgctggctgtgggccctgcctatagcgccattgatctgcctacacacgagaatcatgggctgaaaacaagacaggaaaaatggatgactgggcgcatgggagaaagacagctgcagaaaatcgaacggtggttcgtgcgcaatcctttttttgctgtgactgctctgaccattgcctatctcgtgggatccaatatgacacagcgggtcgtgattgctctgctggtgctggcagtgggacccgcttactccgcccactgtatcggcatcaccgaccgggacttcatcgagggcgtgcacggcggaacatgggtgtccgctaccctggaacaggataagtgcgtgaccgtgatggcccccgacaagcccagcctggacatcagcctggaaaccgtggccatcgatagacccgccgaagtgcggaaagtgtgctacaacgccgtgctgacccacgtgaagatcaacgacaagtgccccagcaccggcgaagcccacctggccgaagagaacgagggcgacaacgcctgcaagcggacctacagcgatagaggctggggcaatggctgcggcctgtttggcaagggcagcatcgtggcctgcgccaagttcacctgtgccaagagcatgagcctgttcgaggtggaccagaccaagatccagtacgtgatccgggctcagctgcacgtgggcgccaagcaggaaaactggaacaccgacatcaagaccctgaagttcgacgccctgagcggctcccaggaagtggaattcatcggctatggcaaggccaccctggaatgtcaggtgcagaccgccgtggacttcggcaacagctatatcgccgagatggaaaccgagagctggatcgtggaccggcagtgggcccaggatctgacactgccttggcagtctggctctggcggagtgtggcgggaaatgcaccacctggtggaattcgagcctccccacgccgccaccattagagtgctggccctgggcaatcaggaaggctctctgaaaacagccctgaccggcgccatgagagtgaccaaggacaccaacgacaacaacctgtacaagctgcacggggggcacgtgtcctgcagagtgaaactgtctgccctgacactgaagggcaccagctacaagatctgcaccgacaagatgttcttcgtgaagaaccccaccgacaccggccacggcacagtcgtgatgcaagtgaaggtgtccaagggcgctccctgccggatccctgtgatcgtggccgatgatctgacagccgccatcaacaagggcatcctcgtgacagtgaaccctatcgcctccaccaacgatgacgaggtgctgatcgaagtgaacccccccttcggcgactcctacatcatcgtgggacggggcgacagcagactgacctaccagtggcacaaagagggcagcagcatcggcaagctgttcacccagaccatgaagggcgtggaacggctggccgtgatgggagataccgcctgggatttctctagcgctggcggcttcttcaccagcgtgggcaagggaatccacaccgtgttcggcagcgccttccagggactgttcggcggcctgaactggatcaccaaagtgatcatgggcgctgtgctgatctgggtgggaatcaacacccggaacatgaccatgagcatgtccatgatcctcgtgggagtgattatgatgttcctgagcctgggcgtgggtgcc

SEQ ID NO: 70 - DNA, 2016 bp, Yellow Fever Virus; identical to SEQ ID NO: 67

SEQ ID NO: 71 - DNA, 2256 bp, Yellow Fever Virus; identical to SEQ ID NO: 69

SEQ ID NO: 72 - DNA, 2241 bp, Yellow Fever Virus; identical to SEQ ID NO: 68

SEQ ID NO: 73 - DNA, 2016 bp, Yellow Fever Virus; identical to SEQ ID NO: 66

SEQ ID NO: 74 - DNA, 2031 bp, Yellow Fever Virus; identical to SEQ ID NO: 65

SEQ ID NO: 75 - DNA, 2241 bp, Artificial Sequence
  Synthetic Polynucleotide
atgtggctggtgtccctggccatcgtgacagcctgtgctggcgctgtgacactcgtgcggaaaaacagatggctgctgctgaacgtgaccagcgaggacctgggcaagaccttctctgtaggcaccggcaactgcaccaccaacatcctggaagccaagtactggtgccccgacagcatggagtacaactgccccaacctgagccccagagaggaacccgacgacatcgactgctggtgctacggcgtggaaaacgtgcgggtggcctacggcaagtgcgatagcgccggcagaagcagaagaagcaggcgggccatcgacctgcccacccacgaaaaccacggcctgaaaacccggcaggaaaagtggatgaccggccggatgggcgagcggcagctgcagaaaattgagcggtggtttgtgcggaaccccttcttcgccgtgaccgccctgacaatcgcctacctcgtgggcagcaacatgacccagagagtcgtgatcgccctgctggtgctggctgtgggccctgcctatagcgccattgatctgcctacacacgagaatcatgggctgaaaacaagacaggaaaaatggatgactgggcgcatgggagaaagacagctgcagaaaatcgaacggtggttcgtgcgcaatcctttttttgctgtgactgctctgaccattgcctatctcgtgggatccaatatgacacagcgggtcgtgattgctctgctggtgctggcagtgggacccgcttactccgcccactgtatcggcatcaccgaccgggacttcatcgagggcgtgcacggcggaacatgggtgtccgctaccctggaacaggataagtgcgtgaccgtgatggcccccgacaagcccagcctggacatcagcctggaaaccgtggccatcgatagacccgccgaagtgcggaaagtgtgctacaacgccgtgctgacccacgtgaagatcaacgacaagtgccccagagaaggcgaagcccacctggccgaagagaacgagggcgacaacgcctgcaagcggacctacagcgatagaggcagaggcaatggctgcggcagatttggcaagggcagcatcgtggcctgcgccaagttcacctgtgccaagagcatgagcctgttcgaggtggaccagaccaagatccagtacgtgatccgggcccagctgcacgtgggagccaagcaggaaaactggaacaccgacatcaagaccctgaagttcgacgccctgagcggctcccaggaagtggaattcatcggctatggcaaggccaccctggaatgtcaggtgcagaccgccgtggacttcggcaacagctatatcgccgagatggaaaccgagagctggatcgtggaccggcagtgggctcaggatctgaccctgccttggcagtctggctctggcggagtgtggcgggaaatgcaccacctggtggaattcgagcctccccacgccgccaccattagagtgctggccctgggcaatcaggaaggctctctgaaaacagccctgaccggcgccatgagagtgaccaaggacaccaacgacaacaacctgtacaagctgcatggcggccacgtgtcctgcagagtgaagctgtctgccctgacactgaagggcaccagctacaagatctgcaccgacaagatgttcttcgtgaagaaccccaccgacaccggccacggcacagtcgtgatgcaagtgaaggtgtccaagggcgctccctgccggatccctgtgatcgtggccgatgatctgacagccgccatcaacaagggcatcctcgtgacagtgaaccctatcgcctccaccaacgatgacgaggtgctgatcgaagtgaacccccccttcggcgactcctacatcatcgtgggacggggcgacagcagactgacctaccagtggcacaaagagggcagcagcatcggcaagctgttcacccagaccatgaagggcgtggaacggctggccgtgatgggagataccgcctgggatttctctagcgctggcggcttcttcaccagcgtgggcaagggaatccacaccgtgttcggcagcgccttccagggactgttcggcggcctgaactggatcaccaaagtgatcatgggcgctgtgctgatctgggtgggaatcaacacccggaacatgaccatgagcatgtccatgatcctcgtgggagtgattatgatgttcctgagcctgggtgtgggcgcc

SEQ ID NO: 76 - DNA, 2256 bp, Artificial Sequence
  Synthetic Polynucleotide
atggaaacccctgcccagctgctgttcctgctgctgctgtggctgcctgataccaccggcgtgacactcgtgcggaagaacagatggctgctgctgaacgtgaccagcgaggacctgggcaagaccttctctgtgggcaccggcaactgcaccaccaacatcctggaagccaagtactggtgccccgacagcatggagtacaactgccccaacctgagccccagagaggaacccgacgacatcgactgctggtgctacggcgtggaaaacgtgcgggtggcctacggcaagtgcgatagcgccggcagaagcagaagaagcaggcgggccatcgacctgcccacccacgaaaaccacggcctgaaaacccggcaggaaaagtggatgaccggccggatgggcgagcggcagctgcagaaaattgagcggtggtttgtgcggaaccccttcttcgccgtgaccgccctgacaatcgcctacctcgtgggcagcaacatgacccagagagtcgtgatcgccctgctggtgctggctgtgggccctgcctatagcgccattgatctgcctacacacgagaatcatgggctgaaaacaagacaggaaaaatggatgactgggcgcatgggagaaagacagctgcagaaaatcgaacggtggttcgtgcgcaatcctttttttgctgtgactgctctgaccattgcctatctcgtgggatccaatatgacacagcgggtcgtgattgctctgctggtgctggcagtgggacccgcttactccgcccactgtatcggcatcaccgaccgggacttcatcgagggcgtgcacggcggaacatgggtgtccgctaccctggaacaggataagtgcgtgaccgtgatggcccccgacaagcccagcctggacatcagcctggaaaccgtggccatcgatagacccgccgaagtgcggaaagtgtgctacaacgccgtgctgacccacgtgaagatcaacgacaagtgccccagagaaggcgaagcccacctggccgaagagaacgagggcgacaacgcctgcaagcggacctacagcgatagaggcagaggcaatggctgcggcagatttggcaagggcagcatcgtggcctgcgccaagttcacctgtgccaagagcatgagcctgttcgaggtggaccagaccaagatccagtacgtgatccgggctcagctgcacgtgggcgccaagcaggaaaactggaacaccgacatcaagaccctgaagttcgacgccctgagcggctcccaggaagtggaattcatcggctatggcaaggccaccctggaatgtcaggtgcagaccgccgtggacttcggcaacagctatatcgccgagatggaaaccgagagctggatcgtggaccggcagtgggcccaggatctgacactgccttggcagtctggctctggcggagtgtggcgggaaatgcaccacctggtggaattcgagcctccccacgccgccaccattagagtgctggccctgggcaatcaggaaggctctctgaaaacagccctgaccggcgccatgagagtgaccaaggacaccaacgacaacaacctgtacaagctgcacggggggcacgtgtcctgcagagtgaaactgtctgccctgacactgaagggcaccagctacaagatctgcaccgacaagatgttcttcgtgaagaaccccaccgacaccggccacggcacagtcgtgatgcaagtgaaggtgtccaagggcgctccctgccggatccctgtgatcgtggccgatgatctgacagccgccatcaacaagggcatcctcgtgacagtgaaccctatcgcctccaccaacgatgacgaggtgctgatcgaagtgaacccccccttcggcgactcctacatcatcgtgggacggggcgacagcagactgacctaccagtggcacaaagagggcagcagcatcggcaagctgttcacccagaccatgaagggcgtggaacggctggccgtgatgggagataccgcctgggatttctctagcgctggcggcttcttcaccagcgtgggcaagggaatccacaccgtgttcggcagcgccttccagggactgttcggcggcctgaactggatcaccaaagtgatcatgggcgctgtgctgatctgggtgggaatcaacacccggaacatgaccatgagcatgtccatgatcctcgtgggagtgattatgatgttcctgagcctgggcgtgggtgcc

SEQ ID NO: 77 - DNA, 2241 bp, Artificial Sequence
  Synthetic Polynucleotide
atgtggctggtgtccctggccatcgtgacagcctgtgctggcgctgtgacactcgtgcggaagaacagatggctgctgctgaacgtgaccagcgaggacctgggcaagaccttctctgtaggcaccggcaactgcaccaccaacatcctggaagccaagtactggtgccccgacagcatggagtacaactgccccaacctgagccccagagaggaacccgacgacatcgactgctggtgctacggcgtggaaaacgtgcgggtggcctacggcaagtgcgatagcgccggcagaagcagaagaagcaggcgggccatcgacctgcccacccacgaaaaccacggcctgaaaacccggcaggaaaagtggatgaccggccggatgggcgagcggcagctgcagaaaattgagcggtggtttgtgcggaaccccttcttcgccgtgaccgccctgacaatcgcctacctcgtgggcagcaacatgacccagagagtcgtgatcgccctgctggtgctggctgtgggccctgcctatagcgccattgatctgcctacacacgagaatcatgggctgaaaacaagacaggagaaatggatgactgggcgcatgggagaaagacagctgcagaaaatcgaacggtggttcgtgcgcaatcctttctttgctgtgactgctctgaccattgcctatctcgtgggatccaatatgacacagcgggtcgtgattgctctgctggtgctggcagtgggacccgcttactccgcccactgtatcggcatcaccgaccgggacttcatcgagggcgtgcacggcggaacatgggtgtccgctaccctggaacaggataagtgcgtgaccgtgatggcccccgacaagcccagcctggacatcagcctggaaaccgtggccatcgatagacccgccgaagtgcggaaagtgtgctacaacgccgtgctgacccacgtgaagatcaacgacaagtgccccagagaaggcgaagcccacctggccgaagagaacgagggcgacaacgcctgcaagcggacctacagcgatagaggcagaggcaatggctgcggcagatttggcaagggcagcatcgtggcctgcgccaagttcacctgtgccaagagcatgagcctgttcgaggtggaccagaccaagatccagtacgtgatccgggcccagctgcacgtgggagccaagcaggaaaactggaacaccgacatcaagaccctgaagttcgacgccctgagcggctcccaggaagtggaattcatcggctatggcaaggccaccctggaatgtcaggtgcagaccgccgtggacttcggcaacagctatatcgccgagatggaaaccgagagctggatcgtggaccggcagtgggctcaggatctgaccctgccttggcagtctggctctggcggagtgtggcgggaaatgcaccacctggtggaattcgagcctccccacgccgccaccattagagtgctggccctgggcaatcaggaaggctctctgaaaacagccctgaccggcgccatgagagtgaccaaggacaccaacgacaacaacctgtacaagctgcatggcggccacgtgtcctgcagagtgaagctgtctgccctgacactgaagggcaccagctacaagatctgcaccgacaagatgttcttcgtgaagaaccccaccgacaccggccacggcacagtcgtgatgcaagtgaaggtgtccaagggcgctccctgccggatccctgtgatcgtggccgatgatctgacagccgccatcaacaagggcatcctcgtgacagtgaaccctatcgcctccaccaacgatgacgaggtgctgatcgaagtgaatcctcccttcggcgactcctacatcatcgtgggacggggcgacagcagactgacctaccagtggcacaaagagggcagcagcatcggcaagctgttcacccagaccatgaagggcgtggaacggctggccgtgatgggagataccgcctgggatttctctagcgctggcggcttcttcaccagcgtgggcaagggaatccacaccgtgttcggcagcgccttccagggactgttcggcggcctgaactggatcaccaaagtgatcatgggcgctgtgctgatctgggtgggaatcaacacccggaacatgaccatgagcatgtccatgatcctcgtgggagtgattatgatgttcctgagcctgggtgtgggcgcc

SEQ ID NO: 78 - DNA, 2241 bp, Artificial Sequence
  Synthetic Polynucleotide
atgtggctggtgtccctggccatcgtgacagcctgtgctggcgctgtgacactcgtgcggaagaacagatggctgctgctgaacgtgaccagcgaggacctgggcaagaccttctctgtaggcaccggcaactgcaccaccaacatcctggaagccaagtactggtgccccgacagcatggagtacaactgccccaacctgagccccagagaggaacccgacgacatcgactgctggtgctacggcgtggaaaacgtgcgggtggcctacggcaagtgcgatagcgccggcagaagcagaagaagcaggcgggccatcgacctgcccacccacgaaaaccacggcctgaaaacccggcaggaaaagtggatgaccggccggatgggcgagcggcagctgcagaaaattgagcggtggtttgtgcggaaccccttcttcgccgtgaccgccctgacaatcgcctacctcgtgggcagcaacatgacccagagagtcgtgatcgccctgctggtgctggctgtgggccctgcctatagcgccattgatctgcctacacacgagaatcatgggctgaaaacaagacaggagaaatggatgactgggcgcatgggagaaagacagctgcagaaaatcgaacggtggttcgtgcgcaatcctttctttgctgtgactgctctgaccattgcctatctcgtgggatccaatatgacacagcgggtcgtgattgctctgctggtgctggcagtgggacccgcttactccgcccactgtatcggcatcaccgaccgggacttcatcgagggcgtgcacggcggaacatgggtgtccgctaccctggaacaggataagtgcgtgaccgtgatggcccccgacaagcccagcctggacatcagcctggaaaccgtggccatcgatagacccgccgaagtgcggaaagtgtgctacaacgccgtgctgacccacgtgaagatcaacgacaagtgccccagcaccggcgaagcccacctggccgaagagaacgagggcgacaacgcctgcaagcggacctacagcgatagaggctggggcaatggctgcggcctgtttggcaagggcagcatcgtggcctgcgccaagttcacctgtgccaagagcatgagcctgttcgaggtggaccagaccaagatccagtacgtgatccgggcccagctgcacgtgggagccaagcaggaaaactggaacaccgacatcaagaccctgaagttcgacgccctgagcggctcccaggaagtggaattcatcggctatggcaaggccaccctggaatgtcaggtgcagaccgccgtggacttcggcaacagctatatcgccgagatggaaaccgagagctggatcgtggaccggcagtgggctcaggatctgaccctgccttggcagtctggctctggcggagtgtggcgggaaatgcaccacctggtggaattcgagcctccccacgccgccaccattagagtgctggccctgggcaatcaggaaggctctctgaaaacagccctgaccggcgccatgagagtgaccaaggacaccaacgacaacaacctgtacaagctgcatggcggccacgtgtcctgcagagtgaagctgtctgccctgacactgaagggcaccagctacaagatctgcaccgacaagatgttcttcgtgaagaaccccaccgacaccggccacggcacagtcgtgatgcaagtgaaggtgtccaagggcgctccctgccggatccctgtgatcgtggccgatgatctgacagccgccatcaacaagggcatcctcgtgacagtgaaccctatcgcctccaccaacgatgacgaggtgctgatcgaagtgaatcctcccttcggcgactcctacatcatcgtgggacggggcgacagcagactgacctaccagtggcacaaagagggcagcagcatcggcaagctgttcacccagaccatgaagggcgtggaacggctggccgtgatgggagataccgcctgggatttctctagcgctggcggcttcttcaccagcgtgggcaagggaatccacaccgtgttcggcagcgccttccagggactgttcggcggcctgaactggatcaccaaagtgatcatgggcgctgtgctgatctgggtgggaatcaacacccggaacatgaccatgagcatgtccatgatcctcgtgggagtgattatgatgttcctgagcctgggtgtgggcgcc

SEQ ID NO: 79 - DNA, 2256 bp, Artificial Sequence
  Synthetic Polynucleotide
atggaaacccctgcccagctgctgttcctgctgctgctgtggctgcctgataccaccggcgtgacactcgtgcggaagaacagatggctgctgctgaacgtgaccagcgaggacctgggcaagaccttctctgtgggcaccggcaactgcaccaccaacatcctggaagccaagtactggtgccccgacagcatggagtacaactgccccaacctgagccccagagaggaacccgacgacatcgactgctggtgctacggcgtggaaaacgtgcgggtggcctacggcaagtgcgatagcgccggcagaagcagaagaagcaggcgggccatcgacctgcccacccacgaaaaccacggcctgaaaacccggcaggaaaagtggatgaccggccggatgggcgagcggcagctgcagaaaattgagcggtggtttgtgcggaaccccttcttcgccgtgaccgccctgacaatcgcctacctcgtgggcagcaacatgacccagagagtcgtgatcgccctgctggtgctggctgtgggccctgcctatagcgccattgatctgcctacacacgagaatcatgggctgaaaacaagacaggagaaatggatgactgggcgcatgggagaaagacagctgcagaaaatcgaacggtggttcgtgcgcaatccgttctttgctgtgactgctctgaccattgcctatctcgtgggatccaatatgacacagcgggtcgtgattgctctgctggtgctggcagtgggacccgcttactccgcccactgtatcggcatcaccgaccgggacttcatcgagggcgtgcacggcggaacatgggtgtccgctaccctggaacaggataagtgcgtgaccgtgatggcccccgacaagcccagcctggacatcagcctggaaaccgtggccatcgatagacccgccgaagtgcggaaagtgtgctacaacgccgtgctgacccacgtgaagatcaacgacaagtgccccagagaaggcgaagcccacctggccgaagagaacgagggcgacaacgcctgcaagcggacctacagcgatagaggcagaggcaatggctgcggcagatttggcaagggcagcatcgtggcctgcgccaagttcacctgtgccaagagcatgagcctgttcgaggtggaccagaccaagatccagtacgtgatccgggctcagctgcacgtgggcgccaagcaggaaaactggaacaccgacatcaagaccctgaagttcgacgccctgagcggctcccaggaagtggaattcatcggctatggcaaggccaccctggaatgtcaggtgcagaccgccgtggacttcggcaacagctatatcgccgagatggaaaccgagagctggatcgtggaccggcagtgggcccaggatctgacactgccttggcagtctggctctggcggagtgtggcgggaaatgcaccacctggtggaattcgagcctccccacgccgccaccattagagtgctggccctgggcaatcaggaaggctctctgaaaacagccctgaccggcgccatgagagtgaccaaggacaccaacgacaacaacctgtacaagctgcacggggggcacgtgtcctgcagagtgaaactgtctgccctgacactgaagggcaccagctacaagatctgcaccgacaagatgttcttcgtgaagaaccccaccgacaccggccacggcacagtcgtgatgcaagtgaaggtgtccaagggcgctccctgccggatccctgtgatcgtggccgatgatctgacagccgccatcaacaagggcatcctcgtgacagtgaaccctatcgcctccaccaacgatgacgaggtgctgatcgaagtgaaccctcctttcggcgactcctacatcatcgtgggacggggcgacagcagactgacctaccagtggcacaaagagggcagcagcatcggcaagctgttcacccagaccatgaagggcgtggaacggctggccgtgatgggagataccgcctgggatttctctagcgctggcggcttcttcaccagcgtgggcaagggaatccacaccgtgttcggcagcgccttccagggactgttcggcggcctgaactggatcaccaaagtgatcatgggcgctgtgctgatctgggtgggaatcaacacccggaacatgaccatgagcatgtccatgatcctcgtgggagtgattatgatgttcctgagcctgggcgtgggtgcc

SEQ ID NO: 80 - DNA, 2256 bp, Artificial Sequence
  Synthetic Polynucleotide
atggaaacccctgcccagctgctgttcctgctgctgctgtggctgcctgataccaccggcgtgacactcgtgcggaagaacagatggctgctgctgaacgtgaccagcgaggacctgggcaagaccttctctgtgggcaccggcaactgcaccaccaacatcctggaagccaagtactggtgccccgacagcatggagtacaactgccccaacctgagccccagagaggaacccgacgacatcgactgctggtgctacggcgtggaaaacgtgcgggtggcctacggcaagtgcgatagcgccggcagaagcagaagaagcaggcgggccatcgacctgcccacccacgaaaaccacggcctgaaaacccggcaggaaaagtggatgaccggccggatgggcgagcggcagctgcagaaaattgagcggtggtttgtgcggaaccccttcttcgccgtgaccgccctgacaatcgcctacctcgtgggcagcaacatgacccagagagtcgtgatcgccctgctggtgctggctgtgggccctgcctatagcgccattgatctgcctacacacgagaatcatgggctgaaaacaagacaggagaaatggatgactgggcgcatgggagaaagacagctgcagaaaatcgaacggtggttcgtgcgcaatccgttctttgctgtgactgctctgaccattgcctatctcgtgggatccaatatgacacagcgggtcgtgattgctctgctggtgctggcagtgggacccgcttactccgcccactgtatcggcatcaccgaccgggacttcatcgagggcgtgcacggcggaacatgggtgtccgctaccctggaacaggataagtgcgtgaccgtgatggcccccgacaagcccagcctggacatcagcctggaaaccgtggccatcgatagacccgccgaagtgcggaaagtgtgctacaacgccgtgctgacccacgtgaagatcaacgacaagtgccccagcaccggcgaagcccacctggccgaagagaacgagggcgacaacgcctgcaagcggacctacagcgatagaggctggggcaatggctgcggcctgtttggcaagggcagcatcgtggcctgcgccaagttcacctgtgccaagagcatgagcctgttcgaggtggaccagaccaagatccagtacgtgatccgggctcagctgcacgtgggcgccaagcaggaaaactggaacaccgacatcaagaccctgaagttcgacgccctgagcggctcccaggaagtggaattcatcggctatggcaaggccaccctggaatgtcaggtgcagaccgccgtggacttcggcaacagctatatcgccgagatggaaaccgagagctggatcgtggaccggcagtgggcccaggatctgacactgccttggcagtctggctctggcggagtgtggcgggaaatgcaccacctggtggaattcgagcctccccacgccgccaccattagagtgctggccctgggcaatcaggaaggctctctgaaaacagccctgaccggcgccatgagagtgaccaaggacaccaacgacaacaacctgtacaagctgcacggggggcacgtgtcctgcagagtgaaactgtctgccctgacactgaagggcaccagctacaagatctgcaccgacaagatgttcttcgtgaagaaccccaccgacaccggccacggcacagtcgtgatgcaagtgaaggtgtccaagggcgctccctgccggatccctgtgatcgtggccgatgatctgacagccgccatcaacaagggcatcctcgtgacagtgaaccctatcgcctccaccaacgatgacgaggtgctgatcgaagtgaaccctcctttcggcgactcctacatcatcgtgggacggggcgacagcagactgacctaccagtggcacaaagagggcagcagcatcggcaagctgttcacccagaccatgaagggcgtggaacggctggccgtgatgggagataccgcctgggatttctctagcgctggcggcttcttcaccagcgtgggcaagggaatccacaccgtgttcggcagcgccttccagggactgttcggcggcctgaactggatcaccaaagtgatcatgggcgctgtgctgatctgggtgggaatcaacacccggaacatgaccatgagcatgtccatgatcctcgtgggagtgattatgatgttcctgagcctgggcgtgggtgcc

SEQ ID NO: 81 - RNA, 2031 nt, Yellow Fever Virus
auggaaaccccugcccagcugcuguuccugcugcugcuguggcugccugauaccaccggcgugacacucgugcggaagaacagauggcugcugcugaacgugaccagcgaggaccugggcaagaccuucucugugggcaccggcaacugcaccaccaacauccuggaagccaaguacuggugccccgacagcauggaguacaacugccccaaccugagccccagagaggaacccgacgacaucgacugcuggugcuacggcguggaaaacgugcggguggccuacggcaagugcgauagcgccggcagaagcagaagaagcaggcgggccaucgaccugcccacccacgaaaaccacggccugaaaacccggcaggaaaaguggaugaccggccggaugggcgagcggcagcugcagaaaaucgagagauggcucgugcgcaaccccuucuucgccgugaccgcccugacaaucgccuaccucgugggcagcaacaugacccagagagucgugaucgcccugcuggugcuggcugugggcccugccuauagcgcccacuguaucggcaucaccgaccgggacuucaucgagggcgugcacggcggaacauggguguccgcuacccuggaacaggauaagugcgugaccgugauggcccccgacaagcccagccuggacaucagccuggaaaccguggccauugacggacccgccgaggccagaaaagugugcuacaacgccgugcugacccacgugaagaucaacgacaagugccccagcaccggcgaagcccaccuggccgaagagaacgagggcgacaacgccugcaagcggaccuacagcgauagaggcuggggcaauggcugcggccuguuuggcaagggcagcaucguggccugcgccaaguucaccugugccaagagcaugagccuguucgagguggaccagaccaagauccaguacgugauccgggcucagcugcacgugggcgccaagcaggaaaacuggaacaccgacaucaagacccugaaguucgacgcccugagcggcucccaggaagccgaguuuaccggcuauggcaaggccacccuggaaugccaggugcagaccgccguggacuucggcaacagcuauaucgccgagauggaaaaagaaagcuggaucguggaccggcagugggcccaggaucugacacugccuuggcagucuggcucuggcggaguguggcgggaaaugcaccaccugguggaauucgagccuccccacgccgccaccauuagagugcuggcccugggcaaucaggaaggcucucugaaaacagcccugaccggcgccaugagagugaccaaggacaccaacgacaacaaccuguacaagcugcacggggggcacguguccugcagagugaaacugucugcccugacacugaagggcaccagcuacaagaugugcaccgacaagaugagcuucgugaagaaccccaccgacaccggccacggcacagucgugaugcaagugaaggugcccaagggcgcucccugcagaaucccugugaucguggccgaugaucugacagccgccaucaacaagggcauccucgugacagugaacccuaucgccuccaccaacgaugacgaggugcugaucgaagugaacccccccuucggcgacuccuacaucaucgugggcacaggcgacagcagacugaccuaccaguggcacaaagagggcagcagcaucggcaagcuguucacccagaccaugaagggcgccgagagacuggcugugaugggagaugccgccugggacuuuagcagcgcuggcggcuucuuuaccagcgugggcaagggaauccacaccguguucggcagcgccuuccagggacuguuuggcggccugagcuggaucaccaaagugaucaugggcgcugugcugaucugggugggaaucaacacccggaacaugaccaugagcauguccaugauccucgugggagugauuaugauguuccugagccugggcgugggagcc

SEQ ID NO: 82 - RNA, 2016 nt, Yellow Fever Virus
auguggcuggugucccuggccaucgugacagccugugcuggcgcugugacacucgugcggaagaacagauggcugcugcugaacgugaccagcgaggaccugggcaagaccuucucugugggcaccggcaacugcaccaccaacauccuggaagccaaguacuggugccccgacagcauggaguacaacugccccaaccugagccccagagaggaacccgacgacaucgacugcuggugcuacggcguggaaaacgugcggguggccuacggcaagugcgauagcgccggcagaagcagaagaagcaggcgggccaucgaccugcccacccacgaaaaccacggccugaaaacccggcaggaaaaguggaugaccggccggaugggcgagcggcagcugcagaaaaucgagagauggcucgugcgcaaccccuucuucgccgugaccgcccugacaaucgccuaccucgugggcagcaacaugacccagagagucgugaucgcccugcuggugcuggcugugggcccugccuauagcgcccacuguaucggcaucaccgaccgggacuucaucgagggcgugcacggcggaacauggguguccgcuacccuggaacaggauaagugcgugaccgugauggcccccgacaagcccagccuggacaucagccuggaaaccguggccauugacggacccgccgaggccagaaaagugugcuacaacgccgugcugacccacgugaagaucaacgacaagugccccagcaccggcgaagcccaccuggccgaagagaacgagggcgacaacgccugcaagcggaccuacagcgauagaggcuggggcaauggcugcggccuguuuggcaagggcagcaucguggccugcgccaaguucaccugugccaagagcaugagccuguucgagguggaccagaccaagauccaguacgugauccgggcccagcugcacgugggagccaagcaggaaaacuggaacaccgacaucaagacccugaaguucgacgcccugagcggcucccaggaagccgaguuuaccggcuauggcaaggccacccuggaaugccaggugcagaccgccguggacuucggcaacagcuauaucgccgagauggaaaaagaaagcuggaucguggaccggcagugggcccaggaccugacacugccuuggcagucuggaucuggcggcguguggcgggaaaugcaccaccugguggaauucgagccuccccaugccgccaccaucagagugcuggcccugggcaaucaggaaggcucucugaaaacagcccugaccggcgccaugagagugaccaaggacaccaacgacaacaaccuguacaagcugcauggcggccacguguccugcagagugaagcugucugcccugacccugaaaggcaccagcuacaagaugugcaccgacaagaugagcuucgugaagaaccccaccgacaccggccacggcacagucgugaugcaagugaaggugcccaagggcgcucccugcagaaucccugugaucguggccgaugaucugacagccgccaucaacaagggcauccucgugacagugaacccuaucgccuccaccaacgaugacgaggugcugaucgaagugaacccccccuucggcgacuccuacaucaucgugggcacaggcgacagcagacugaccuaccaguggcacaaagagggcagcagcaucggcaagcuguucacccagaccaugaagggcgccgagagacuggcugugaugggagaugccgccugggacuuuagcagcgcuggcggcuucuuuaccagcgugggcaagggaauccacaccguguucggcagcgccuuccagggacuguuuggcggccugagcuggaucaccaaagugaucaugggcgcugugcugaucugggugggaaucaacacccggaacaugaccaugagcauguccaugauccucgugggagugauuaugauguuccugagccugggcgugggcgcc

SEQ ID NO: 83 - RNA, 2016 nt, Yellow Fever Virus
auguggcuggugucccuggccaucgugacagccugugcuggcgcugugacacucgugcggaagaacagauggcugcugcugaacgugaccagcgaggaccugggcaagaccuucucugugggcaccggcaacugcaccaccaacauccuggaagccaaguacuggugccccgacagcauggaguacaacugccccaaccugagccccagagaggaacccgacgacaucgacugcuggugcuacggcguggaaaacgugcggguggccuacggcaagugcgauagcgccggcagaagcagaagaagcaggcgggccaucgaccugcccacccacgaaaaccacggccugaaaacccggcaggaaaaguggaugaccggccggaugggcgagcggcagcugcagaaaaucgagagauggcucgugcgcaaccccuucuucgccgugaccgcccugacaaucgccuaccucgugggcagcaacaugacccagagagucgugaucgcccugcuggugcuggcugugggcccugccuauagcgcccacuguaucggcaucaccgaccgggacuucaucgagggcgugcacggcggaacauggguguccgcuacccuggaacaggauaagugcgugaccgugauggcccccgacaagcccagccuggacaucagccuggaaaccguggccauugacggacccgccgaggccagaaaagugugcuacaacgccgugcugacccacgugaagaucaacgacaagugccccagcaccggcgaagcccaccuggccgaagagaacgagggcgacaacgccugcaagcggaccuacagcgauagaggcuggggcaauggcugcggccuguuuggcaagggcagcaucguggccugcgccaaguucaccugugccaagagcaugagccuguucgagguggaccagaccaagauccaguacgugauccgggcccagcugcacgugggagccaagcaggaaaacuggaccaccgacaucaagacccugaaguucgacgcccugagcggcucccaggaagccgaguuuaccggcuauggcaaggccacccuggaaugccaggugcagaccgccguggacuucggcaacagcuauaucgccgagauggaaaaagaaagcuggaucguggaccggcagugggcccaggaccugacacugccuuggcagucuggaucuggcggcguguggcgggaaaugcaccaccugguggaauucgagccuccccaugccgccaccaucagagugcuggcccugggcaaucaggaaggcucucugaaaacagcccugaccggcgccaugagagugaccaaggacaccaacgacaacaaccuguacaagcugcauggcggccacguguccugcagagugaagcugucugcccugacccugaaaggcaccagcuacaagaugugcaccgacaagaugagcuucgugaagaaccccaccgacaccggccacggcacagucgugaugcaagugaaggugcccaagggcgcucccugcagaaucccugugaucguggccgaugaucugacagccgccaucaacaagggcauccucgugacagugaacccuaucgccuccaccaacgaugacgaggugcugaucgaagugaacccccccuucggcgacuccuacaucaucgugggcacaggcgacagcagacugaccuaccaguggcacaaagagggcagcagcaucggcaagcuguucacccagaccaugaagggcgccgagagacuggcugugaugggagaugccgccugggacuuuagcagcgcuggcggcuucuuuaccagcgugggcaagggaauccacaccguguucggcagcgccuuccagggacuguuuggcggccugagcuggaucaccaaagugaucaugggcgcugugcugaucugggugggaaucaacacccggaacaugaccaugagcauguccaugauccucgugggagugauuaugauguuccugagccugggcgugggcgcc

SEQ ID NO: 84 - RNA, 2241 nt, Yellow Fever Virus
auguggcuggugucccuggccaucgugacagccugugcuggcgcugugacacucgugcggaaaaacagauggcugcugcugaacgugaccagcgaggaccugggcaagaccuucucuguaggcaccggcaacugcaccaccaacauccuggaagccaaguacuggugccccgacagcauggaguacaacugccccaaccugagccccagagaggaacccgacgacaucgacugcuggugcuacggcguggaaaacgugcggguggccuacggcaagugcgauagcgccggcagaagcagaagaagcaggcgggccaucgaccugcccacccacgaaaaccacggccugaaaacccggcaggaaaaguggaugaccggccggaugggcgagcggcagcugcagaaaauugagcggugguuugugcggaaccccuucuucgccgugaccgcccugacaaucgccuaccucgugggcagcaacaugacccagagagucgugaucgcccugcuggugcuggcugugggcccugccuauagcgccauugaucugccuacacacgagaaucaugggcugaaaacaagacaggaaaaauggaugacugggcgcaugggagaaagacagcugcagaaaaucgaacggugguucgugcgcaauccuuuuuuugcugugacugcucugaccauugccuaucucgugggauccaauaugacacagcgggucgugauugcucugcuggugcuggcagugggacccgcuuacuccgcccacuguaucggcaucaccgaccgggacuucaucgagggcgugcacggcggaacauggguguccgcuacccuggaacaggauaagugcgugaccgugauggcccccgacaagcccagccuggacaucagccuggaaaccguggccaucgauagacccgccgaagugcggaaagugugcuacaacgccgugcugacccacgugaagaucaacgacaagugccccagcaccggcgaagcccaccuggccgaagagaacgagggcgacaacgccugcaagcggaccuacagcgauagaggcuggggcaauggcugcggccuguuuggcaagggcagcaucguggccugcgccaaguucaccugugccaagagcaugagccuguucgagguggaccagaccaagauccaguacgugauccgggcccagcugcacgugggagccaagcaggaaaacuggaacaccgacaucaagacccugaaguucgacgcccugagcggcucccaggaaguggaauucaucggcuauggcaaggccacccuggaaugucaggugcagaccgccguggacuucggcaacagcuauaucgccgagauggaaaccgagagcuggaucguggaccggcagugggcucaggaucugacccugccuuggcagucuggcucuggcggaguguggcgggaaaugcaccaccugguggaauucgagccuccccacgccgccaccauuagagugcuggcccugggcaaucaggaaggcucucugaaaacagcccugaccggcgccaugagagugaccaaggacaccaacgacaacaaccuguacaagcugcauggcggccacguguccugcagagugaagcugucugcccugacacugaagggcaccagcuacaagaucugcaccgacaagauguucuucgugaagaaccccaccgacaccggccacggcacagucgugaugcaagugaagguguccaagggcgcucccugccggaucccugugaucguggccgaugaucugacagccgccaucaacaagggcauccucgugacagugaacccuaucgccuccaccaacgaugacgaggugcugaucgaagugaacccccccuucggcgacuccuacaucaucgugggacggggcgacagcagacugaccuaccaguggcacaaagagggcagcagcaucggcaagcuguucacccagaccaugaagggcguggaacggcuggccgugaugggagauaccgccugggauuucucuagcgcuggcggcuucuucaccagcgugggcaagggaauccacaccguguucggcagcgccuuccagggacuguucggcggccugaacuggaucaccaaagugaucaugggcgcugugcugaucugggugggaaucaacacccggaacaugaccaugagcauguccaugauccucgugggagugauuaugauguuccugagccugggugugggcgcc

SEQ ID NO: 85 - RNA, 2256 nt, Yellow Fever Virus
auggaaaccccugcccagcugcuguuccugcugcugcuguggcugccugauaccaccggcgugacacucgugcggaagaacagauggcugcugcugaacgugaccagcgaggaccugggcaagaccuucucugugggcaccggcaacugcaccaccaacauccuggaagccaaguacuggugccccgacagcauggaguacaacugccccaaccugagccccagagaggaacccgacgacaucgacugcuggugcuacggcguggaaaacgugcggguggccuacggcaagugcgauagcgccggcagaagcagaagaagcaggcgggccaucgaccugcccacccacgaaaaccacggccugaaaacccggcaggaaaaguggaugaccggccggaugggcgagcggcagcugcagaaaauugagcggugguuugugcggaaccccuucuucgccgugaccgcccugacaaucgccuaccucgugggcagcaacaugacccagagagucgugaucgcccugcuggugcuggcugugggcccugccuauagcgccauugaucugccuacacacgagaaucaugggcugaaaacaagacaggaaaaauggaugacugggcgcaugggagaaagacagcugcagaaaaucgaacggugguucgugcgcaauccuuuuuuugcugugacugcucugaccauugccuaucucgugggauccaauaugacacagcgggucgugauugcucugcuggugcuggcagugggacccgcuuacuccgcccacuguaucggcaucaccgaccgggacuucaucgagggcgugcacggcggaacauggguguccgcuacccuggaacaggauaagugcgugaccgugauggcccccgacaagcccagccuggacaucagccuggaaaccguggccaucgauagacccgccgaagugcggaaagugugcuacaacgccgugcugacccacgugaagaucaacgacaagugccccagcaccggcgaagcccaccuggccgaagagaacgagggcgacaacgccugcaagcggaccuacagcgauagaggcuggggcaauggcugcggccuguuuggcaagggcagcaucguggccugcgccaaguucaccugugccaagagcaugagccuguucgagguggaccagaccaagauccaguacgugauccgggcucagcugcacgugggcgccaagcaggaaaacuggaacaccgacaucaagacccugaaguucgacgcccugagcggcucccaggaaguggaauucaucggcuauggcaaggccacccuggaaugucaggugcagaccgccguggacuucggcaacagcuauaucgccgagauggaaaccgagagcuggaucguggaccggcagugggcccaggaucugacacugccuuggcagucuggcucuggcggaguguggcgggaaaugcaccaccugguggaauucgagccuccccacgccgccaccauuagagugcuggcccugggcaaucaggaaggcucucugaaaacagcccugaccggcgccaugagagugaccaaggacaccaacgacaacaaccuguacaagcugcacggggggcacguguccugcagagugaaacugucugcccugacacugaagggcaccagcuacaagaucugcaccgacaagauguucuucgugaagaaccccaccgacaccggccacggcacagucgugaugcaagugaagguguccaagggcgcucccugccggaucccugugaucguggccgaugaucugacagccgccaucaacaagggcauccucgugacagugaacccuaucgccuccaccaacgaugacgaggugcugaucgaagugaacccccccuucggcgacuccuacaucaucgugggacggggcgacagcagacugaccuaccaguggcacaaagagggcagcagcaucggcaagcuguucacccagaccaugaagggcguggaacggcuggccgugaugggagauaccgccugggauuucucuagcgcuggcggcuucuucaccagcgugggcaagggaauccacaccguguucggcagcgccuuccagggacuguucggcggccugaacuggaucaccaaagugaucaugggcgcugugcugaucugggugggaaucaacacccggaacaugaccaugagcauguccaugauccucgugggagugauuaugauguuccugagccugggcgugggugcc

SEQ ID NO: 86 - RNA, 2016 nt, Yellow Fever Virus; identical to SEQ ID NO: 83

SEQ ID NO: 87 - RNA, 2256 nt, Yellow Fever Virus; identical to SEQ ID NO: 85

SEQ ID NO: 88 - RNA, 2241 nt, Yellow Fever Virus; identical to SEQ ID NO: 84

SEQ ID NO: 89 - RNA, 2016 nt, Yellow Fever Virus; identical to SEQ ID NO: 82

SEQ ID NO: 90 - RNA, 2031 nt, Yellow Fever Virus; identical to SEQ ID NO: 81

SEQ ID NO: 91 - RNA, 2241 nt, Artificial Sequence
  Synthetic Polynucleotide
auguggcuggugucccuggccaucgugacagccugugcuggcgcugugacacucgugcggaaaaacagauggcugcugcugaacgugaccagcgaggaccugggcaagaccuucucuguaggcaccggcaacugcaccaccaacauccuggaagccaaguacuggugccccgacagcauggaguacaacugccccaaccugagccccagagaggaacccgacgacaucgacugcuggugcuacggcguggaaaacgugcggguggccuacggcaagugcgauagcgccggcagaagcagaagaagcaggcgggccaucgaccugcccacccacgaaaaccacggccugaaaacccggcaggaaaaguggaugaccggccggaugggcgagcggcagcugcagaaaauugagcggugguuugugcggaaccccuucuucgccgugaccgcccugacaaucgccuaccucgugggcagcaacaugacccagagagucgugaucgcccugcuggugcuggcugugggcccugccuauagcgccauugaucugccuacacacgagaaucaugggcugaaaacaagacaggaaaaauggaugacugggcgcaugggagaaagacagcugcagaaaaucgaacggugguucgugcgcaauccuuuuuuugcugugacugcucugaccauugccuaucucgugggauccaauaugacacagcgggucgugauugcucugcuggugcuggcagugggacccgcuuacuccgcccacuguaucggcaucaccgaccgggacuucaucgagggcgugcacggcggaacauggguguccgcuacccuggaacaggauaagugcgugaccgugauggcccccgacaagcccagccuggacaucagccuggaaaccguggccaucgauagacccgccgaagugcggaaagugugcuacaacgccgugcugacccacgugaagaucaacgacaagugccccagagaaggcgaagcccaccuggccgaagagaacgagggcgacaacgccugcaagcggaccuacagcgauagaggcagaggcaauggcugcggcagauuuggcaagggcagcaucguggccugcgccaaguucaccugugccaagagcaugagccuguucgagguggaccagaccaagauccaguacgugauccgggcccagcugcacgugggagccaagcaggaaaacuggaacaccgacaucaagacccugaaguucgacgcccugagcggcucccaggaaguggaauucaucggcuauggcaaggccacccuggaaugucaggugcagaccgccguggacuucggcaacagcuauaucgccgagauggaaaccgagagcuggaucguggaccggcagugggcucaggaucugacccugccuuggcagucuggcucuggcggaguguggcgggaaaugcaccaccugguggaauucgagccuccccacgccgccaccauuagagugcuggcccugggcaaucaggaaggcucucugaaaacagcccugaccggcgccaugagagugaccaaggacaccaacgacaacaaccuguacaagcugcauggcggccacguguccugcagagugaagcugucugcccugacacugaagggcaccagcuacaagaucugcaccgacaagauguucuucgugaagaaccccaccgacaccggccacggcacagucgugaugcaagugaagguguccaagggcgcucccugccggaucccugugaucguggccgaugaucugacagccgccaucaacaagggcauccucgugacagugaacccuaucgccuccaccaacgaugacgaggugcugaucgaagugaacccccccuucggcgacuccuacaucaucgugggacggggcgacagcagacugaccuaccaguggcacaaagagggcagcagcaucggcaagcuguucacccagaccaugaagggcguggaacggcuggccgugaugggagauaccgccugggauuucucuagcgcuggcggcuucuucaccagcgugggcaagggaauccacaccguguucggcagcgccuuccagggacuguucggcggccugaacuggaucaccaaagugaucaugggcgcugugcugaucugggugggaaucaacacccggaacaugaccaugagcauguccaugauccucgugggagugauuaugauguuccugagccugggugugggcgcc

SEQ ID NO: 92 - RNA, 2256 nt, Artificial Sequence
  Synthetic Polynucleotide
auggaaaccccugcccagcugcuguuccugcugcugcuguggcugccugauaccaccggcgugacacucgugcggaagaacagauggcugcugcugaacgugaccagcgaggaccugggcaagaccuucucugugggcaccggcaacugcaccaccaacauccuggaagccaaguacuggugccccgacagcauggaguacaacugccccaaccugagccccagagaggaacccgacgacaucgacugcuggugcuacggcguggaaaacgugcggguggccuacggcaagugcgauagcgccggcagaagcagaagaagcaggcgggccaucgaccugcccacccacgaaaaccacggccugaaaacccggcaggaaaaguggaugaccggccggaugggcgagcggcagcugcagaaaauugagcggugguuugugcggaaccccuucuucgccgugaccgcccugacaaucgccuaccucgugggcagcaacaugacccagagagucgugaucgcccugcuggugcuggcugugggcccugccuauagcgccauugaucugccuacacacgagaaucaugggcugaaaacaagacaggaaaaauggaugacugggcgcaugggagaaagacagcugcagaaaaucgaacggugguucgugcgcaauccuuuuuuugcugugacugcucugaccauugccuaucucgugggauccaauaugacacagcgggucgugauugcucugcuggugcuggcagugggacccgcuuacuccgcccacuguaucggcaucaccgaccgggacuucaucgagggcgugcacggcggaacauggguguccgcuacccuggaacaggauaagugcgugaccgugauggcccccgacaagcccagccuggacaucagccuggaaaccguggccaucgauagacccgccgaagugcggaaagugugcuacaacgccgugcugacccacgugaagaucaacgacaagugccccagagaaggcgaagcccaccuggccgaagagaacgagggcgacaacgccugcaagcggaccuacagcgauagaggcagaggcaauggcugcggcagauuuggcaagggcagcaucguggccugcgccaaguucaccugugccaagagcaugagccuguucgagguggaccagaccaagauccaguacgugauccgggcucagcugcacgugggcgccaagcaggaaaacuggaacaccgacaucaagacccugaaguucgacgcccugagcggcucccaggaaguggaauucaucggcuauggcaaggccacccuggaaugucaggugcagaccgccguggacuucggcaacagcuauaucgccgagauggaaaccgagagcuggaucguggaccggcagugggcccaggaucugacacugccuuggcagucuggcucuggcggaguguggcgggaaaugcaccaccugguggaauucgagccuccccacgccgccaccauuagagugcuggcccugggcaaucaggaaggcucucugaaaacagcccugaccggcgccaugagagugaccaaggacaccaacgacaacaaccuguacaagcugcacggggggcacguguccugcagagugaaacugucugcccugacacugaagggcaccagcuacaagaucugcaccgacaagauguucuucgugaagaaccccaccgacaccggccacggcacagucgugaugcaagugaagguguccaagggcgcucccugccggaucccugugaucguggccgaugaucugacagccgccaucaacaagggcauccucgugacagugaacccuaucgccuccaccaacgaugacgaggugcugaucgaagugaacccccccuucggcgacuccuacaucaucgugggacggggcgacagcagacugaccuaccaguggcacaaagagggcagcagcaucggcaagcuguucacccagaccaugaagggcguggaacggcuggccgugaugggagauaccgccugggauuucucuagcgcuggcggcuucuucaccagcgugggcaagggaauccacaccguguucggcagcgccuuccagggacuguucggcggccugaacuggaucaccaaagugaucaugggcgcugugcugaucugggugggaaucaacacccggaacaugaccaugagcauguccaugauccucgugggagugauuaugauguuccugagccugggcgugggugcc

SEQ ID NO: 93 - RNA, 2241 nt, Artificial Sequence
  Synthetic Polynucleotide
auguggcuggugucccuggccaucgugacagccugugcuggcgcugugacacucgugcggaagaacagauggcugcugcugaacgugaccagcgaggaccugggcaagaccuucucuguaggcaccggcaacugcaccaccaacauccuggaagccaaguacuggugccccgacagcauggaguacaacugccccaaccugagccccagagaggaacccgacgacaucgacugcuggugcuacggcguggaaaacgugcggguggccuacggcaagugcgauagcgccggcagaagcagaagaagcaggcgggccaucgaccugcccacccacgaaaaccacggccugaaaacccggcaggaaaaguggaugaccggccggaugggcgagcggcagcugcagaaaauugagcggugguuugugcggaaccccuucuucgccgugaccgcccugacaaucgccuaccucgugggcagcaacaugacccagagagucgugaucgcccugcuggugcuggcugugggcccugccuauagcgccauugaucugccuacacacgagaaucaugggcugaaaacaagacaggagaaauggaugacugggcgcaugggagaaagacagcugcagaaaaucgaacggugguucgugcgcaauccuuucuuugcugugacugcucugaccauugccuaucucgugggauccaauaugacacagcgggucgugauugcucugcuggugcuggcagugggacccgcuuacuccgcccacuguaucggcaucaccgaccgggacuucaucgagggcgugcacggcggaacauggguguccgcuacccuggaacaggauaagugcgugaccgugauggcccccgacaagcccagccuggacaucagccuggaaaccguggccaucgauagacccgccgaagugcggaaagugugcuacaacgccgugcugacccacgugaagaucaacgacaagugccccagagaaggcgaagcccaccuggccgaagagaacgagggcgacaacgccugcaagcggaccuacagcgauagaggcagaggcaauggcugcggcagauuuggcaagggcagcaucguggccugcgccaaguucaccugugccaagagcaugagccuguucgagguggaccagaccaagauccaguacgugauccgggcccagcugcacgugggagccaagcaggaaaacuggaacaccgacaucaagacccugaaguucgacgcccugagcggcucccaggaaguggaauucaucggcuauggcaaggccacccuggaaugucaggugcagaccgccguggacuucggcaacagcuauaucgccgagauggaaaccgagagcuggaucguggaccggcagugggcucaggaucugacccugccuuggcagucuggcucuggcggaguguggcgggaaaugcaccaccugguggaauucgagccuccccacgccgccaccauuagagugcuggcccugggcaaucaggaaggcucucugaaaacagcccugaccggcgccaugagagugaccaaggacaccaacgacaacaaccuguacaagcugcauggcggccacguguccugcagagugaagcugucugcccugacacugaagggcaccagcuacaagaucugcaccgacaagauguucuucgugaagaaccccaccgacaccggccacggcacagucgugaugcaagugaagguguccaagggcgcucccugccggaucccugugaucguggccgaugaucugacagccgccaucaacaagggcauccucgugacagugaacccuaucgccuccaccaacgaugacgaggugcugaucgaagugaauccucccuucggcgacuccuacaucaucgugggacggggcgacagcagacugaccuaccaguggcacaaagagggcagcagcaucggcaagcuguucacccagaccaugaagggcguggaacggcuggccgugaugggagauaccgccugggauuucucuagcgcuggcggcuucuucaccagcgugggcaagggaauccacaccguguucggcagcgccuuccagggacuguucggcggccugaacuggaucaccaaagugaucaugggcgcugugcugaucugggugggaaucaacacccggaacaugaccaugagcauguccaugauccucgugggagugauuaugauguuccugagccugggugugggcgcc

SEQ ID NO: 94 - RNA, 2241 nt, Artificial Sequence
  Synthetic Polynucleotide
auguggcuggugucccuggccaucgugacagccugugcuggcgcugugacacucgugcggaagaacagauggcugcugcugaacgugaccagcgaggaccugggcaagaccuucucuguaggcaccggcaacugcaccaccaacauccuggaagccaaguacuggugccccgacagcauggaguacaacugccccaaccugagccccagagaggaacccgacgacaucgacugcuggugcuacggcguggaaaacgugcggguggccuacggcaagugcgauagcgccggcagaagcagaagaagcaggcgggccaucgaccugcccacccacgaaaaccacggccugaaaacccggcaggaaaaguggaugaccggccggaugggcgagcggcagcugcagaaaauugagcggugguuugugcggaaccccuucuucgccgugaccgcccugacaaucgccuaccucgugggcagcaacaugacccagagagucgugaucgcccugcuggugcuggcugugggcccugccuauagcgccauugaucugccuacacacgagaaucaugggcugaaaacaagacaggagaaauggaugacugggcgcaugggagaaagacagcugcagaaaaucgaacggugguucgugcgcaauccuuucuuugcugugacugcucugaccauugccuaucucgugggauccaauaugacacagcgggucgugauugcucugcuggugcuggcagugggacccgcuuacuccgcccacuguaucggcaucaccgaccgggacuucaucgagggcgugcacggcggaacauggguguccgcuacccuggaacaggauaagugcgugaccgugauggcccccgacaagcccagccuggacaucagccuggaaaccguggccaucgauagacccgccgaagugcggaaagugugcuacaacgccgugcugacccacgugaagaucaacgacaagugccccagcaccggcgaagcccaccuggccgaagagaacgagggcgacaacgccugcaagcggaccuacagcgauagaggcuggggcaauggcugcggccuguuuggcaagggcagcaucguggccugcgccaaguucaccugugccaagagcaugagccuguucgagguggaccagaccaagauccaguacgugauccgggcccagcugcacgugggagccaagcaggaaaacuggaacaccgacaucaagacccugaaguucgacgcccugagcggcucccaggaaguggaauucaucggcuauggcaaggccacccuggaaugucaggugcagaccgccguggacuucggcaacagcuauaucgccgagauggaaaccgagagcuggaucguggaccggcagugggcucaggaucugacccugccuuggcagucuggcucuggcggaguguggcgggaaaugcaccaccugguggaauucgagccuccccacgccgccaccauuagagugcuggcccugggcaaucaggaaggcucucugaaaacagcccugaccggcgccaugagagugaccaaggacaccaacgacaacaaccuguacaagcugcauggcggccacguguccugcagagugaagcugucugcccugacacugaagggcaccagcuacaagaucugcaccgacaagauguucuucgugaagaaccccaccgacaccggccacggcacagucgugaugcaagugaagguguccaagggcgcucccugccggaucccugugaucguggccgaugaucugacagccgccaucaacaagggcauccucgugacagugaacccuaucgccuccaccaacgaugacgaggugcugaucgaagugaauccucccuucggcgacuccuacaucaucgugggacggggcgacagcagacugaccuaccaguggcacaaagagggcagcagcaucggcaagcuguucacccagaccaugaagggcguggaacggcuggccgugaugggagauaccgccugggauuucucuagcgcuggcggcuucuucaccagcgugggcaagggaauccacaccguguucggcagcgccuuccagggacuguucggcggccugaacuggaucaccaaagugaucaugggcgcugugcugaucugggugggaaucaacacccggaacaugaccaugagcauguccaugauccucgugggagugauuaugauguuccugagccugggugugggcgcc

SEQ ID NO: 95 - RNA, 2256 nt, Artificial Sequence
  Synthetic Polynucleotide
auggaaaccccugcccagcugcuguuccugcugcugcuguggcugccugauaccaccggcgugacacucgugcggaagaacagauggcugcugcugaacgugaccagcgaggaccugggcaagaccuucucugugggcaccggcaacugcaccaccaacauccuggaagccaaguacuggugccccgacagcauggaguacaacugccccaaccugagccccagagaggaacccgacgacaucgacugcuggugcuacggcguggaaaacgugcggguggccuacggcaagugcgauagcgccggcagaagcagaagaagcaggcgggccaucgaccugcccacccacgaaaaccacggccugaaaacccggcaggaaaaguggaugaccggccggaugggcgagcggcagcugcagaaaauugagcggugguuugugcggaaccccuucuucgccgugaccgcccugacaaucgccuaccucgugggcagcaacaugacccagagagucgugaucgcccugcuggugcuggcugugggcccugccuauagcgccauugaucugccuacacacgagaaucaugggcugaaaacaagacaggagaaauggaugacugggcgcaugggagaaagacagcugcagaaaaucgaacggugguucgugcgcaauccguucuuugcugugacugcucugaccauugccuaucucgugggauccaauaugacacagcgggucgugauugcucugcuggugcuggcagugggacccgcuuacuccgcccacuguaucggcaucaccgaccgggacuucaucgagggcgugcacggcggaacauggguguccgcuacccuggaacaggauaagugcgugaccgugauggcccccgacaagcccagccuggacaucagccuggaaaccguggccaucgauagacccgccgaagugcggaaagugugcuacaacgccgugcugacccacgugaagaucaacgacaagugccccagagaaggcgaagcccaccuggccgaagagaacgagggcgacaacgccugcaagcggaccuacagcgauagaggcagaggcaauggcugcggcagauuuggcaagggcagcaucguggccugcgccaaguucaccugugccaagagcaugagccuguucgagguggaccagaccaagauccaguacgugauccgggcucagcugcacgugggcgccaagcaggaaaacuggaacaccgacaucaagacccugaaguucgacgcccugagcggcucccaggaaguggaauucaucggcuauggcaaggccacccuggaaugucaggugcagaccgccguggacuucggcaacagcuauaucgccgagauggaaaccgagagcuggaucguggaccggcagugggcccaggaucugacacugccuuggcagucuggcucuggcggaguguggcgggaaaugcaccaccugguggaauucgagccuccccacgccgccaccauuagagugcuggcccugggcaaucaggaaggcucucugaaaacagcccugaccggcgccaugagagugaccaaggacaccaacgacaacaaccuguacaagcugcacggggggcacguguccugcagagugaaacugucugcccugacacugaagggcaccagcuacaagaucugcaccgacaagauguucuucgugaagaaccccaccgacaccggccacggcacagucgugaugcaagugaagguguccaagggcgcucccugccggaucccugugaucguggccgaugaucugacagccgccaucaacaagggcauccucgugacagugaacccuaucgccuccaccaacgaugacgaggugcugaucgaagugaacccuccuuucggcgacuccuacaucaucgugggacggggcgacagcagacugaccuaccaguggcacaaagagggcagcagcaucggcaagcuguucacccagaccaugaagggcguggaacggcuggccgugaugggagauaccgccugggauuucucuagcgcuggcggcuucuucaccagcgugggcaagggaauccacaccguguucggcagcgccuuccagggacuguucggcggccugaacuggaucaccaaagugaucaugggcgcugugcugaucugggugggaaucaacacccggaacaugaccaugagcauguccaugauccucgugggagugauuaugauguuccugagccugggcgugggugcc

SEQ ID NO: 96 - RNA, 2256 nt, Artificial Sequence
  Synthetic Polynucleotide
auggaaaccccugcccagcugcuguuccugcugcugcuguggcugccugauaccaccggcgugacacucgugcggaagaacagauggcugcugcugaacgugaccagcgaggaccugggcaagaccuucucugugggcaccggcaacugcaccaccaacauccuggaagccaaguacuggugccccgacagcauggaguacaacugccccaaccugagccccagagaggaacccgacgacaucgacugcuggugcuacggcguggaaaacgugcggguggccuacggcaagugcgauagcgccggcagaagcagaagaagcaggcgggccaucgaccugcccacccacgaaaaccacggccugaaaacccggcaggaaaaguggaugaccggccggaugggcgagcggcagcugcagaaaauugagcggugguuugugcggaaccccuucuucgccgugaccgcccugacaaucgccuaccucgugggcagcaacaugacccagagagucgugaucgcccugcuggugcuggcugugggcccugccuauagcgccauugaucugccuacacacgagaaucaugggcugaaaacaagacaggagaaauggaugacugggcgcaugggagaaagacagcugcagaaaaucgaacggugguucgugcgcaauccguucuuugcugugacugcucugaccauugccuaucucgugggauccaauaugacacagcgggucgugauugcucugcuggugcuggcagugggacccgcuuacuccgcccacuguaucggcaucaccgaccgggacuucaucgagggcgugcacggcggaacauggguguccgcuacccuggaacaggauaagugcgugaccgugauggcccccgacaagcccagccuggacaucagccuggaaaccguggccaucgauagacccgccgaagugcggaaagugugcuacaacgccgugcugacccacgugaagaucaacgacaagugccccagcaccggcgaagcccaccuggccgaagagaacgagggcgacaacgccugcaagcggaccuacagcgauagaggcuggggcaauggcugcggccuguuuggcaagggcagcaucguggccugcgccaaguucaccugugccaagagcaugagccuguucgagguggaccagaccaagauccaguacgugauccgggcucagcugcacgugggcgccaagcaggaaaacuggaacaccgacaucaagacccugaaguucgacgcccugagcggcucccaggaaguggaauucaucggcuauggcaaggccacccuggaaugucaggugcagaccgccguggacuucggcaacagcuauaucgccgagauggaaaccgagagcuggaucguggaccggcagugggcccaggaucugacacugccuuggcagucuggcucuggcggaguguggcgggaaaugcaccaccugguggaauucgagccuccccacgccgccaccauuagagugcuggcccugggcaaucaggaaggcucucugaaaacagcccugaccggcgccaugagagugaccaaggacaccaacgacaacaaccuguacaagcugcacggggggcacguguccugcagagugaaacugucugcccugacacugaagggcaccagcuacaagaucugcaccgacaagauguucuucgugaagaaccccaccgacaccggccacggcacagucgugaugcaagugaagguguccaagggcgcucccugccggaucccugugaucguggccgaugaucugacagccgccaucaacaagggcauccucgugacagugaacccuaucgccuccaccaacgaugacgaggugcugaucgaagugaacccuccuuucggcgacuccuacaucaucgugggacggggcgacagcagacugaccuaccaguggcacaaagagggcagcagcaucggcaagcuguucacccagaccaugaagggcguggaacggcuggccgugaugggagauaccgccugggauuucucuagcgcuggcggcuucuucaccagcgugggcaagggaauccacaccguguucggcagcgccuuccagggacuguucggcggccugaacuggaucaccaaagugaucaugggcgcugugcugaucugggugggaaucaacacccggaacaugaccaugagcauguccaugauccucgugggagugauuaugauguuccugagccugggcgugggugcc

SEQ ID NO: 97 - protein, 677 aa, Yellow Fever Virus
METPAQLLFLLLLWLPDTTGVTLVRKNRWLLLNVTSEDLGKTFSVGTGNCTTNILEAKYWCPDSMEYNCPNLSPREEPDDIDCWCYGVENVRVAYGKCDSAGRSRRSRRAIDLPTHENHGLKTRQEKWMTGRMGERQLQKIERWLVRNPFFAVTALTIAYLVGSNMTQRVVIALLVLAVGPAYSAHCIGITDRDFIEGVHGGTWVSATLEQDKCVTVMAPDKPSLDISLETVAIDGPAEARKVCYNAVLTHVKINDKCPSTGEAHLAEENEGDNACKRTYSDRGWGNGCGLFGKGSIVACAKFTCAKSMSLFEVDQTKIQYVIRAQLHVGAKQENWNTDIKTLKFDALSGSQEAEFTGYGKATLECQVQTAVDFGNSYIAEMEKESWIVDRQWAQDLTLPWQSGSGGVWREMHHLVEFEPPHAATIRVLALGNQEGSLKTALTGAMRVTKDTNDNNLYKLHGGHVSCRVKLSALTLKGTSYKMCTDKMSFVKNPTDTGHGTVVMQVKVPKGAPCRIPVIVADDLTAAINKGILVTVNPIASTNDDEVLIEVNPPFGDSYIIVGTGDSRLTYQWHKEGSSIGKLFTQTMKGAERLAVMGDAAWDFSSAGGFFTSVGKGIHTVFGSAFQGLFGGLSWITKVIMGAVLIWVGINTRNMTMSMSMILVGVIMMFLSLGVGA

SEQ ID NO: 98 - protein, 672 aa, Yellow Fever Virus
MWLVSLAIVTACAGAVTLVRKNRWLLLNVTSEDLGKTFSVGTGNCTTNILEAKYWCPDSMEYNCPNLSPREEPDDIDCWCYGVENVRVAYGKCDSAGRSRRSRRAIDLPTHENHGLKTRQEKWMTGRMGERQLQKIERWLVRNPFFAVTALTIAYLVGSNMTQRVVIALLVLAVGPAYSAHCIGITDRDFIEGVHGGTWVSATLEQDKCVTVMAPDKPSLDISLETVAIDGPAEARKVCYNAVLTHVKINDKCPSTGEAHLAEENEGDNACKRTYSDRGWGNGCGLFGKGSIVACAKFTCAKSMSLFEVDQTKIQYVIRAQLHVGAKQENWNTDIKTLKFDALSGSQEAEFTGYGKATLECQVQTAVDFGNSYIAEMEKESWIVDRQWAQDLTLPWQSGSGGVWREMHHLVEFEPPHAATIRVLALGNQEGSLKTALTGAMRVTKDTNDNNLYKLHGGHVSCRVKLSALTLKGTSYKMCTDKMSFVKNPTDTGHGTVVMQVKVPKGAPCRIPVIVADDLTAAINKGILVTVNPIASTNDDEVLIEVNPPFGDSYIIVGTGDSRLTYQWHKEGSSIGKLFTQTMKGAERLAVMGDAAWDFSSAGGFFTSVGKGIHTVFGSAFQGLFGGLSWITKVIMGAVLIWVGINTRNMTMSMSMILVGVIMMFLSLGVGA

SEQ ID NO: 99 - protein, 672 aa, Yellow Fever Virus
MWLVSLAIVTACAGAVTLVRKNRWLLLNVTSEDLGKTFSVGTGNCTTNILEAKYWCPDSMEYNCPNLSPREEPDDIDCWCYGVENVRVAYGKCDSAGRSRRSRRAIDLPTHENHGLKTRQEKWMTGRMGERQLQKIERWLVRNPFFAVTALTIAYLVGSNMTQRVVIALLVLAVGPAYSAHCIGITDRDFIEGVHGGTWVSATLEQDKCVTVMAPDKPSLDISLETVAIDGPAEARKVCYNAVLTHVKINDKCPSTGEAHLAEENEGDNACKRTYSDRGWGNGCGLFGKGSIVACAKFTCAKSMSLFEVDQTKIQYVIRAQLHVGAKQENWTTDIKTLKFDALSGSQEAEFTGYGKATLECQVQTAVDFGNSYIAEMEKESWIVDRQWAQDLTLPWQSGSGGVWREMHHLVEFEPPHAATIRVLALGNQEGSLKTALTGAMRVTKDTNDNNLYKLHGGHVSCRVKLSALTLKGTSYKMCTDKMSFVKNPTDTGHGTVVMQVKVPKGAPCRIPVIVADDLTAAINKGILVTVNPIASTNDDEVLIEVNPPFGDSYIIVGTGDSRLTYQWHKEGSSIGKLFTQTMKGAERLAVMGDAAWDFSSAGGFFTSVGKGIHTVFGSAFQGLFGGLSWITKVIMGAVLIWVGINTRNMTMSMSMILVGVIMMFLSLGVGA

SEQ ID NO: 100 - protein, 747 aa, Yellow Fever Virus
MWLVSLAIVTACAGAVTLVRKNRWLLLNVTSEDLGKTFSVGTGNCTTNILEAKYWCPDSMEYNCPNLSPREEPDDIDCWCYGVENVRVAYGKCDSAGRSRRSRRAIDLPTHENHGLKTRQEKWMTGRMGERQLQKIERWFVRNPFFAVTALTIAYLVGSNMTQRVVIALLVLAVGPAYSAIDLPTHENHGLKTRQEKWMTGRMGERQLQKIERWFVRNPFFAVTALTIAYLVGSNMTQRVVIALLVLAVGPAYSAHCIGITDRDFIEGVHGGTWVSATLEQDKCVTVMAPDKPSLDISLETVAIDRPAEVRKVCYNAVLTHVKINDKCPSTGEAHLAEENEGDNACKRTYSDRGWGNGCGLFGKGSIVACAKFTCAKSMSLFEVDQTKIQYVIRAQLHVGAKQENWNTDIKTLKFDALSGSQEVEFIGYGKATLECQVQTAVDFGNSYIAEMETESWIVDRQWAQDLTLPWQSGSGGVWREMHHLVEFEPPHAATIRVLALGNQEGSLKTALTGAMRVTKDTNDNNLYKLHGGHVSCRVKLSALTLKGTSYKICTDKMFFVKNPTDTGHGTVVMQVKVSKGAPCRIPVIVADDLTAAINKGILVTVNPIASTNDDEVLIEVNPPFGDSYIIVGRGDSRLTYQWHKEGSSIGKLFTQTMKGVERLAVMGDTAWDFSSAGGFFTSVGKGIHTVFGSAFQGLFGGLNWITKVIMGAVLIWVGINTRNMTMSMSMILVGVIMMFLSLGVGA

SEQ ID NO: 101 - protein, 752 aa, Yellow Fever Virus
METPAQLLFLLLLWLPDTTGVTLVRKNRWLLLNVTSEDLGKTFSVGTGNCTTNILEAKYWCPDSMEYNCPNLSPREEPDDIDCWCYGVENVRVAYGKCDSAGRSRRSRRAIDLPTHENHGLKTRQEKWMTGRMGERQLQKIERWFVRNPFFAVTALTIAYLVGSNMTQRVVIALLVLAVGPAYSAIDLPTHENHGLKTRQEKWMTGRMGERQLQKIERWFVRNPFFAVTALTIAYLVGSNMTQRVVIALLVLAVGPAYSAHCIGITDRDFIEGVHGGTWVSATLEQDKCVTVMAPDKPSLDISLETVAIDRPAEVRKVCYNAVLTHVKINDKCPSTGEAHLAEENEGDNACKRTYSDRGWGNGCGLFGKGSIVACAKFTCAKSMSLFEVDQTKIQYVIRAQLHVGAKQENWNTDIKTLKFDALSGSQEVEFIGYGKATLECQVQTAVDFGNSYIAEMETESWIVDRQWAQDLTLPWQSGSGGVWREMHHLVEFEPPHAATIRVLALGNQEGSLKTALTGAMRVTKDTNDNNLYKLHGGHVSCRVKLSALTLKGTSYKICTDKMFFVKNPTDTGHGTVVMQVKVSKGAPCRIPVIVADDLTAAINKGILVTVNPIASTNDDEVLIEVNPPFGDSYIIVGRGDSRLTYQWHKEGSSIGKLFTQTMKGVERLAVMGDTAWDFSSAGGFFTSVGKGIHTVFGSAFQGLFGGLNWITKVIMGAVLIWVGINTRNMTMSMSMILVGVIMMFLSLGVGA

SEQ ID NO: 102 - protein, 657 aa, Yellow Fever Virus
VTLVRKNRWLLLNVTSEDLGKTFSVGTGNCTTNILEAKYWCPDSMEYNCPNLSPREEPDDIDCWCYGVENVRVAYGKCDSAGRSRRSRRAIDLPTHENHGLKTRQEKWMTGRMGERQLQKIERWLVRNPFFAVTALTIAYLVGSNMTQRVVIALLVLAVGPAYSAHCIGITDRDFIEGVHGGTWVSATLEQDKCVTVMAPDKPSLDISLETVAIDGPAEARKVCYNAVLTHVKINDKCPSTGEAHLAEENEGDNACKRTYSDRGWGNGCGLFGKGSIVACAKFTCAKSMSLFEVDQTKIQYVIRAQLHVGAKQENWNTDIKTLKFDALSGSQEAEFTGYGKATLECQVQTAVDFGNSYIAEMEKESWIVDRQWAQDLTLPWQSGSGGVWREMHHLVEFEPPHAATIRVLALGNQEGSLKTALTGAMRVTKDTNDNNLYKLHGGHVSCRVKLSALTLKGTSYKMCTDKMSFVKNPTDTGHGTVVMQVKVPKGAPCRIPVIVADDLTAAINKGILVTVNPIASTNDDEVLIEVNPPFGDSYIIVGTGDSRLTYQWHKEGSSIGKLFTQTMKGAERLAVMGDAAWDFSSAGGFFTSVGKGIHTVFGSAFQGLFGGLSWITKVIMGAVLIWVGINTRNMTMSMSMILVGVIMMFLSLGVGA

SEQ ID NO: 103 - protein, 657 aa, Yellow Fever Virus; identical to SEQ ID NO: 102

SEQ ID NO: 104 - protein, 657 aa, Yellow Fever Virus
VTLVRKNRWLLLNVTSEDLGKTFSVGTGNCTTNILEAKYWCPDSMEYNCPNLSPREEPDDIDCWCYGVENVRVAYGKCDSAGRSRRSRRAIDLPTHENHGLKTRQEKWMTGRMGERQLQKIERWLVRNPFFAVTALTIAYLVGSNMTQRVVIALLVLAVGPAYSAHCIGITDRDFIEGVHGGTWVSATLEQDKCVTVMAPDKPSLDISLETVAIDGPAEARKVCYNAVLTHVKINDKCPSTGEAHLAEENEGDNACKRTYSDRGWGNGCGLFGKGSIVACAKFTCAKSMSLFEVDQTKIQYVIRAQLHVGAKQENWTTDIKTLKFDALSGSQEAEFTGYGKATLECQVQTAVDFGNSYIAEMEKESWIVDRQWAQDLTLPWQSGSGGVWREMHHLVEFEPPHAATIRVLALGNQEGSLKTALTGAMRVTKDTNDNNLYKLHGGHVSCRVKLSALTLKGTSYKMCTDKMSFVKNPTDTGHGTVVMQVKVPKGAPCRIPVIVADDLTAAINKGILVTVNPIASTNDDEVLIEVNPPFGDSYIIVGTGDSRLTYQWHKEGSSIGKLFTQTMKGAERLAVMGDAAWDFSSAGGFFTSVGKGIHTVFGSAFQGLFGGLSWITKVIMGAVLIWVGINTRNMTMSMSMILVGVIMMFLSLGVGA

SEQ ID NO: 105 - protein, 732 aa, Yellow Fever Virus
VTLVRKNRWLLLNVTSEDLGKTFSVGTGNCTTNILEAKYWCPDSMEYNCPNLSPREEPDDIDCWCYGVENVRVAYGKCDSAGRSRRSRRAIDLPTHENHGLKTRQEKWMTGRMGERQLQKIERWFVRNPFFAVTALTIAYLVGSNMTQRVVIALLVLAVGPAYSAIDLPTHENHGLKTRQEKWMTGRMGERQLQKIERWFVRNPFFAVTALTIAYLVGSNMTQRVVIALLVLAVGPAYSAHCIGITDRDFIEGVHGGTWVSATLEQDKCVTVMAPDKPSLDISLETVAIDRPAEVRKVCYNAVLTHVKINDKCPSTGEAHLAEENEGDNACKRTYSDRGWGNGCGLFGKGSIVACAKFTCAKSMSLFEVDQTKIQYVIRAQLHVGAKQENWNTDIKTLKFDALSGSQEVEFIGYGKATLECQVQTAVDFGNSYIAEMETESWIVDRQWAQDLTLPWQSGSGGVWREMHHLVEFEPPHAATIRVLALGNQEGSLKTALTGAMRVTKDTNDNNLYKLHGGHVSCRVKLSALTLKGTSYKICTDKMFFVKNPTDTGHGTVVMQVKVSKGAPCRIPVIVADDLTAAINKGILVTVNPIASTNDDEVLIEVNPPFGDSYIIVGRGDSRLTYQWHKEGSSIGKLFTQTMKGVERLAVMGDTAWDFSSAGGFFTSVGKGIHTVFGSAFQGLFGGLNWITKVIMGAVLIWVGINTRNMTMSMSMILVGVIMMFLSLGVGA

SEQ ID NO: 106 - protein, 732 aa, Yellow Fever Virus; identical to SEQ ID NO: 105

SEQ ID NO: 107 - protein, 672 aa, Yellow Fever Virus; identical to SEQ ID NO: 99

SEQ ID NO: 108 - protein, 752 aa, Yellow Fever Virus; identical to SEQ ID NO: 101

SEQ ID NO: 109 - protein, 747 aa, Yellow Fever Virus; identical to SEQ ID NO: 100

SEQ ID NO: 110 - protein, 672 aa, Yellow Fever Virus; identical to SEQ ID NO: 98

SEQ ID NO: 111 - protein, 677 aa, Yellow Fever Virus; identical to SEQ ID NO: 97

SEQ ID NO: 112 - protein, 747 aa, Artificial Sequence
  Synthetic Polynucleotide
MWLVSLAIVTACAGAVTLVRKNRWLLLNVTSEDLGKTFSVGTGNCTTNILEAKYWCPDSMEYNCPNLSPREEPDDIDCWCYGVENVRVAYGKCDSAGRSRRSRRAIDLPTHENHGLKTRQEKWMTGRMGERQLQKIERWFVRNPFFAVTALTIAYLVGSNMTQRVVIALLVLAVGPAYSAIDLPTHENHGLKTRQEKWMTGRMGERQLQKIERWFVRNPFFAVTALTIAYLVGSNMTQRVVIALLVLAVGPAYSAHCIGITDRDFIEGVHGGTWVSATLEQDKCVTVMAPDKPSLDISLETVAIDRPAEVRKVCYNAVLTHVKINDKCPREGEAHLAEENEGDNACKRTYSDRGRGNGCGRFGKGSIVACAKFTCAKSMSLFEVDQTKIQYVIRAQLHVGAKQENWNTDIKTLKFDALSGSQEVEFIGYGKATLECQVQTAVDFGNSYIAEMETESWIVDRQWAQDLTLPWQSGSGGVWREMHHLVEFEPPHAATIRVLALGNQEGSLKTALTGAMRVTKDTNDNNLYKLHGGHVSCRVKLSALTLKGTSYKICTDKMFFVKNPTDTGHGTVVMQVKVSKGAPCRIPVIVADDLTAAINKGILVTVNPIASTNDDEVLIEVNPPFGDSYIIVGRGDSRLTYQWHKEGSSIGKLFTQTMKGVERLAVMGDTAWDFSSAGGFFTSVGKGIHTVFGSAFQGLFGGLNWITKVIMGAVLIWVGINTRNMTMSMSMILVGVIMMFLSLGVGA

SEQ ID NO: 113 - protein, 752 aa, Artificial Sequence
  Synthetic Polynucleotide
METPAQLLFLLLLWLPDTTGVTLVRKNRWLLLNVTSEDLGKTFSVGTGNCTTNILEAKYWCPDSMEYNCPNLSPREEPDDIDCWCYGVENVRVAYGKCDSAGRSRRSRRAIDLPTHENHGLKTRQEKWMTGRMGERQLQKIERWFVRNPFFAVTALTIAYLVGSNMTQRVVIALLVLAVGPAYSAIDLPTHENHGLKTRQEKWMTGRMGERQLQKIERWFVRNPFFAVTALTIAYLVGSNMTQRVVIALLVLAVGPAYSAHCIGITDRDFIEGVHGGTWVSATLEQDKCVTVMAPDKPSLDISLETVAIDRPAEVRKVCYNAVLTHVKINDKCPREGEAHLAEENEGDNACKRTYSDRGRGNGCGRFGKGSIVACAKFTCAKSMSLFEVDQTKIQYVIRAQLHVGAKQENWNTDIKTLKFDALSGSQEVEFIGYGKATLECQVQTAVDFGNSYIAEMETESWIVDRQWAQDLTLPWQSGSGGVWREMHHLVEFEPPHAATIRVLALGNQEGSLKTALTGAMRVTKDTNDNNLYKLHGGHVSCRVKLSALTLKGTSYKICTDKMFFVKNPTDTGHGTVVMQVKVSKGAPCRIPVIVADDLTAAINKGILVTVNPIASTNDDEVLIEVNPPFGDSYIIVGRGDSRLTYQWHKEGSSIGKLFTQTMKGVERLAVMGDTAWDFSSAGGFFTSVGKGIHTVFGSAFQGLFGGLNWITKVIMGAVLIWVGINTRNMTMSMSMILVGVIMMFLSLGVGA

SEQ ID NO: 114 - protein, 747 aa, Artificial Sequence; identical to SEQ ID NO: 112
  Synthetic Polynucleotide

SEQ ID NO: 115 - protein, 747 aa, Artificial Sequence; identical to SEQ ID NO: 100
  Synthetic Polynucleotide

SEQ ID NO: 116 - protein, 752 aa, Artificial Sequence; identical to SEQ ID NO: 113
  Synthetic Polynucleotide

SEQ ID NO: 117 - protein, 752 aa, Artificial Sequence; identical to SEQ ID NO: 101
  Synthetic Polynucleotide

SEQ ID NO: 118 - DNA, 10254 bp, Zika Virus
atgaaaaacccaaagaagaaatccggaggattccggattgtcaatatgctaaaacgcggagtagcccgtgtaaaccccttgggaggtttgaagaggctgccagccggacttctgctgggtcatggacccatcagaatggttttggcgatattagcctttttgagattcacagcaatcaagccatcactgggcctcatcaacagatggggtaccgtggggaaaaaagaggctatggaaataataaaaaaatttaagaaagatcttgctgccatgttgagaataatcaatgctaggaaggagaggaagagacgtggcgcagacaccagcatcggaatcgttggcctcctgttgactacagccatggcagcagagatcactagacgtgggagtgcatactacatgtacttggataggagcgatgcagggaaggccatttctttcgctaccacattgggggtgaacaaatgccatgtgcagatcatggacctcgggcacatgtgtgacgccaccatgagctatgaatgccctatgctggacgagggggtggaaccagatgacgtcgattgctggtgcaacacgacatcaacttgggttgtgtacggaacctgtcatcataaaaaaggtgaagcacggcgatctagaagagccgtcacgctcccatctcactccacaaggaaattgcaaacgcggtcgcagacttggctagaatcaagagaatacacaaagcacctgatcaaggttgaaaattggatattcaggaaccctggttttacgctagtggctgtcgccatcgcctggcttttgggaagctcgacgagccaaaaagtcatatacttggtcatgatactgctgattgccccggcatacagtatcaggtgcataggagtcagcaatagagacttcgtggagggcatgtcaggtgggacctgggttgacgttgtcctggaacatggaggctgcgtcaccgtgatggcacaggacaagccaacagttgacatagagctggtcacaacaacggttagtaacatggccgaggtgagatcctattgttacgaggcatcaatatcggacatggcttcggacagtcgctgcccaacacaaggtgaagcctaccttgacaagcaatcagacactcaatatgtttgcaaaagaacattggtggacagaggttggggaaatgggtgtggactctttggcaaagggagtttggtgacatgtgctaagttcacgtgctccaagaagatgactgggaagagcattcagccggagaacctggagtatcggataatgctatcagtgcatggctcccagcacagtgggatgattgttaatgatgaaaacagagcgaaggtcgaggttacgcccaattcaccaagagcagaagcaaccctgggaggctttggaagcttaggacttgattgtgaaccaaggacaggccttgacttttcagatctgtattacctaaccatgaataacaagcattggttggtgcacaaagagtggtttcatgacatcccattgccctggcatgctggggcagacactggaactccacattggaacaacaaggaggcattagtggaattcaaggacgcccacgccaagaggcaaaccgtcgtggttttggggagccaggaaggagccgtccacacggctcttgctggagctctagaggctgagatggatggtgcaaagggaaggctattctctggccacttgaaatgtcgcttaaaaatggacaagcttagattgaagggcgtgtcatattccttgtgcaccgcggcattcacattcaccaaggtcccggctgaaacactacatggaacagtcacagtggaggtgcagtatgcagggacagatggaccctgcaaggtcccagcccagatggcggtggacatgcagaccttgaccccagtcggaaggctgataaccgccaaccccgtgattactgaaagcactgagaattcaaagatgatgttggagctcgacccaccatttggggattcttacattgtcataggagttggggataagaaaatcacccatcactggcataggagtggcagcaccattggaaaagcatttgaagccactgtgagaggcgctaagagaatggcagtcctgggggacacagcttgggactttggatcagtcggaggtgtgtttaactcattgggcaagggcattcatcagatttttggagcagctttcaaatcactgtttggaggaatgtcctggttctcacagatcctcataggcactctgctggtgtggttaggtctgaacacaaagaatgggtctatctccctcacatgcttagccctggggggagtgatgatcttcctctccacggctgtttctgctgacgtggggtgctcggtggacttctcaaaaaaagaaacgagatgtggcacgggggtgttcgtctacaatgacgttgaagcctggagggaccggtacaagtaccatcctgactcccctcgtagactggcagcagccgttaagcaagcttgggaagaggggatttgtgggatctcctctgtttctagaatggaaaacataatgtggaaatcagtggaaggagagctcaatgcaatcctagaggagaatggagtccaactgacagttgttgtgggatctgtaaaaaaccccatgtggagaggcccacaaagattgccagtgcctgtgaatgagctgccccatggctggaaagcctgggggaaatcgtactttgttagggcggcaaagaccaacaacagttttgttgtcgacggtgacacattgaaggaatgtccgctcaagcacagagcatggaacagcttcctcgtggaggatcacgggtttggggtcttccacaccagtgtttggcttaaggttagagaagattactcactggagtgtgacccagccgtcataggaacagctgttaagggaaaggaggccgcgcacagtgatctaggctattggattgaaagtgaaaagaatgacacatggaggctgaagagggctcatttgattgagatgaaaacatgtgagtggccaaagtctcacacactgtggacagatggagtggaagaaagtgatctgatcatacccaagtctttagctggtccactcagccaccacaacaccagagagggttacagaactcaagtgaaagggccatggcatagtgaggagcttgaaatccgatttgaggaatgtccaggtaccaaggttcatgtggaggagacatgcggaacgagaggaccatctctgagatcaaccactgcaagcggaagggtcattgaggaatggtgctgtagggaatgcacaatgcccccactatcgttccgagcaaaagatggctgctggtatggaatggagataaggcctaggaaagaaccagagagcaacttagtgaggtcaatggtgacagcgggatcaaccgatcatatggatcatttttctcttggagtgcttgtgattctactcatggtgcaggaagggttgaagaagagaatgaccacaaagatcatcatgagcacatcaatggcagtgctggtggccatgatcttgggaggattctcaatgagtgacctggctaagcttgtgatcctgatgggggccactttcgcagaaatgaacactggaggagacgtagctcacttggcattagtagcggcatttaaagtcagaccagccttgctggtctcatttatcttcagagccaactggacacctcgtgagagcatgctgctagccttggcttcgtgtcttctgcaaactgcgatctccgctcttgaaggcgacttgatggtcctcgttaatggatttgctttggcctggttggcaatacgtgcaatggccgtgccacgcactgacaacatcgctctagcaattctggctgctctaacaccactagcccgaggcacactgctcgtggcatggagagcgggcctcgccacttgtggagggttcatgctcctctccctgaaagggaaaggtagtgtgaagaagaacctgccattcgtcgcggccttgggattgaccgctgtgagaatagtggaccccattaatgtggtgggactactgttactcacaaggagtgggaagcggagctggccccctagtgaagtgctcactgctgtcggcctgatatgtgcattggccggagggtttgccaaggcagacatagagatggctgggcccatggcggcagtgggcctgctaattgtcagttatgtggtctcgggaaagagtgtagatatgtacattgaaagagcaggtgacatcacatgggagaaagacgcggaagtcactggaaacagtcctcggcttgacgtggcactagatgagagtggtgatttctctctggtggaggaagatggtccacccatgagagagatcatacttaaggtggtcttgatggccatctgtggcatgaacccaatagccataccttttgctgcaggagcgtggtatgtgtatgtgaagactgggaaaaggagtggtgccctctgggacgtgcctgctccgaaagaagtgaaaaaaggagagaccacagatggagtgtacagagtgatgactcgcagactgctgggttcaacacaagttggagtgggagtcatgcaggagggagtcttccacaccatgtggcacgtcacaaaaggggccgcattgaggagcggtgaagggagacttgatccatactggggggatgtcaagcaggacttggtgtcatattgtgggccttggaagctggacgcagcttgggacggagttagtgaggtgcagcttctggccgtaccccctggagagagagccagaaacattcagactctgcctggaatatttaagacaaaggatggggacatcggagcagttgctttggactatcctgcaggaacctcaggatctccgatcctagacaaatgcgggagagtgataggactctatggcaatggggttgtgatcaagaacggaagctatgttagtgctataacccagggaaagagggaggaggagactccggttgagtgttttgaaccctcgatgctgaagaagaagcagctaactgtcctggacctgcatccaggggctgggaaaaccaggagagttcttcctgaaatagtccgtgaagctataaagaagagactccgcacggtgatcttggcaccaaccagggtcgtcgctgctgagatggaggaagccctgagaggacttccggtgcgttacatgacaacagcagtcaaggtcacccattctgggacagaaatcgttgatttgatgtgccatgccaccttcacttcacgcctactacaacccattagagtccctaattacaacctctacatcatggatgaagcccatttcacagacccctcaagcatagctgcaagaggatatatatcaacaagggttgagatgggcgaggcagcagccatctttatgactgccacaccaccaggaacccgcgatgcgtttccagattccaactcaccaatcatggacacagaagtggaagtcccagagagagcctggagctcaggctttgattgggtgacggaccattctgggaaaacagtttggttcgttccaagcgtgaggaatggaaatgaaatcgcagcctgtctgacaaaggctggaaagcgggttatacagcttagtaggaaaacttttgagacagagtttcagaaaacaaaaaatcaagagtgggactttgtcataacaactgacatctcagagatgggtgccaacttcaaggctgaccgggttatagattccaggagatgcctaaagccagttatacttgatggtgagagagtcatcttggctgggcccatgcctgtcacgcatgctagcgctgctcagaggagaggacgtataggcaggaaccccaacaagcctggagatgagtacatgtatggaggtgggtgtgcggagactgatgaagaccatgcacattggcttgaagcaagaatgcttcttgacaacatttacctccaggatggcctcatagcctcgctctatcgacctgaggccgacaaggtagccgccattgagggagagtttaagctgaggacagagcaaaggaagacctttgtggaactcatgaagagaggagatcttcccgtttggttggcctaccaggttgcatctgccggaataacttatacagacagaagatggtgttttgatggcacaaccaacaacaccataatggaagacagtgtaccagcagaggtgtggaccaagtatggagagaagagagtgctcaaaccaagatggatggacgccagggtctgctcagatcatgcggccctgaagtcgttcaaagaattcgccgctgggaaaagaggagcggctttgggagtaatggaggccctgggaacattaccaggacacatgacagagaggtttcaggaagccattgataacctcgctgtgctcatgcgagcagagactggaagcaggccctacaaggcagcggcagcccaattgccggagaccctagagaccatcatgcttttaggcctgctgggaacagtatcgctggggatcttttttgtcttgatgaggaacaagggcatcgggaagatgggctttgaaatggtaacccttggggccagcgcatggctcatgtggctctcagaaatcgaaccagccagaattgcatgtgtccttattgttgtgtttttattactggtggtgctaataccagagccagagaagcaaagatccccccaggacaatcagatggcaatcattattatggtggcagtgggccttttggggttgataactgcaaatgaacttggatggctggagagaacaaaaaatgacatagctcatctgatgggaaagagagaagagggaacaaccgtgggattctcaatggacatcgatctgcgaccagcctccgcatgggctatttatgccgcattgacaaccctcatcaccccagccgtccagcacgcggtaactacctcgtacaacaactactccttaatggcgatggccacacaagctggagtgctgtttggcatgggcaaagggatgccattttatgcatgggacttaggagtcccgttgctaatgatgggctgctactcacaactaacacccctgaccctgatagtagccatcattttgcttgtggcacattacatgtacttgatcccaggcctacaggcagcagcagcacgcgctgcccagaagagaacagcagccggcatcatgaagaatcccgttgtggatggaatagtggtaactgacattgacacaatgacaattgacccccaagtggagaagaagatgggacaagtgctacttatagcagtggctgtctccagtgctgtgttgctgcggaccgcttggggatggggggaggctggagctttgatcacagcagcaacttccaccctgtgggaaggctccccaaacaaatactggaactcctccacagccacctcactgtgcaacatcttcagaggaagttacttggcaggagcttcccttatttacacagtgacaagaaatgccggcctggttaagagacgtggaggtggaacgggagaaactctgggagagaagtggaaagcccgcctgaatcagatgtcggccttggagttctactcttacaaaaagtcaggcatcactgaagtatgtagagaggaggctcgccgcgccctcaaggatggagtggccacaggaggacatgctgtatcccgaggaagcgcaaaactcagatggttggtggagagaggatatctgcagccctatggaaaggttgttgatctcggatgcggcagagggggctggagttattatgccgccaccatccgcaaagtgcaggaggtgagaggatacacaaagggaggtcccggtcatgaagagcccatgctggtgcaaagctatgggtggaacataattcgtctcaagagtggagtggacgtcttccacatggcggctgagtcgtgtgacactttgctgtgtgacataggtgagtcatcatccagtcctgaagtggaggagacgcgaacactcagagtgctctccatggtgggggactggcttgagaagagaccaggggccttctgcataaaggtgttatgcccatacaccagcaccatgatggagaccatggagcgactgcaacgtaggtatgggggaggactagtcagagtgccactgtcccgcaattctacacatgagatgtattgggtctctggagcaaaaagtaacatcataaaaagtgtgtccaccacaagtcagctcctcctgggacgcatggatgggcccaggaggccagtgaagtatgaggaggatgtgaacctcggctcaggcacacgagctgtggcaagctgtgctgaggctcccaacatgaaggtcattggtaggcgcattgagagaatccgtagtgaacatgcagaaacatggttctttgatgaaaaccatccatacaggacatgggcctaccacgggagctacgaagcccccacgcaagggtcagcatcttccctcgtgaatggggttgttagactcctgtcaaagccctgggatgtggtgactggagttacaggaatagctatgactgacaccacaccgtacggccaacaaagagtcttcaaagaaaaagtggacaccagggtgccagaccctcaagaaggtactcgccaggtaatgaacatggtcgcttcctggctgtggaaggagctgggaaaacgtaagcggccacgtgtctgcaccaaagaagagttcatcaacaaggtgcgcagcaatgcagcactgggagcaatatttgaagaggaaaaagaatggaagacggctgtggaagctgtgaatgatccaaggttttgggccctagtggataaggaaagagaacaccacctgagaggagagtgccatagttgtgtgtacaacatgatgggaaaaagagaaaagaagcaaggggaattcgggaaagcaaaaggcagtcgcgccatctggtacatgtggttgggagccagattcttggagtttgaagcccttggattcttgaacgaggaccattggatgggaagagaaaactcaggaggtggtgtcgaagggttgggactgcaaagacttggatacgttctagaagaaatgagccgggcaccaggaggaaagatgtatgcagatgacaccgctggctgggacacccgcattagcaagtttgatttggagaatgaagccttgattactaaccaaatggatgaagggcacagaactctggcgttggccgtgattaagtacacataccaaaacaaagtggtgaaggtcctcagaccagctgaaggaggaaaaacagtcatggacatcatttcaagacaagaccagagggggagcggacaagttgtcacttatgctctcaacacatttaccaacttggtggtgcagctcatccggaacatggaggctgaggaagtgttagagatgcaagacttatggctgttgaggaagccagagaaagtaaccagatggctgcagagtagcggatgggacagactcaaacgaatggcagtcagtggtgatgactgtgttgtaaagccaattgatgacaggtttgcacacgccctcaggttcttgaatgatatggggaaagttaggaaagacacacaggaatggaaaccctcaactggatggagcaactgggaagaagtcccgttctgctcccaccactttaacaagctgcacctcaaagacgggagatccattgtggtcccttgccgccaccaagatgaactgattggccgggctcgcgtttcgccgggggcaggatggagcatccgggagactgcctgtcttgcaaaatcatatgcacagatgtggcagcttctttatttccacagaagagacctccgactgatggccaatgccatttgctcggccgtgccagttgactgggtcccaactgggagaactacctggtcaatccatggaaagggagaatggatgactactgaggacatgctcatggtgtggaatagagtgtggattgaggagaatgatcacatggaggacaagacccctgtaacaaaatggacagacattccctatttgggaaaaagggaggacttatggtgtggatcccttataggacacagacctcgcaccacttgggctgagaacatcaaagacacagtcagcatggtgcgcagaatcataggtgatgaagaaaagtacatggactacctatccactcaagttcgctacttgggtgaggaagggtctacacctggagtgctgtaa

SEQ ID NO: 119 - DNA, 2281 bp, Zika Virus
tcaagcttttggaccctcgtacagaagctaatacgactcactatagggaaataagagagaaaagaagagtaagaagaaatataagagccaccatggactggacctggatcctgttcctggtggccgctgccacaagagtgcacagcgtggaagtgaccagacggggcagcgcctactacatgtacctggacagaagcgacgccggcgaggccatcagctttccaaccaccctgggcatgaacaagtgctacatccagatcatggacctgggccacatgtgcgacgccaccatgagctacgagtgccccatgctggacgagggcgtggaacccgacgatgtggactgctggtgcaacaccaccagcacctgggtggtgtacggcacctgtcaccacaagaagggcgaagccagacggtccagacgggccgtgacactgcctagccacagcaccagaaagctgcagacccggtcccagacctggctggaaagcagagagtacaccaagcacctgatccgggtggaaaactggatcttccggaaccccggctttgccctggctgccgctgctattgcttggctgctgggcagcagcacctcccagaaagtgatctacctcgtgatgatcctgctgatcgcccctgcctacagcatccggtgtatcggcgtgtccaaccgggacttcgtggaaggcatgagcggcggcacatgggtggacgtggtgctggaacatggcggctgcgtgacagtgatggcccaggataagcccgccgtggacatcgagctcgtgaccaccaccgtgtccaatatggccgaagtgcggagctactgctacgaggccagcatcagcgacatggccagcgacagcagatgccctacacagggcgaggcctacctggataagcagtccgacacccagtacgtgtgcaagcggaccctggtggatagaggctggggcaatggctgcggcctgtttggcaagggcagcctcgtgacctgcgccaagttcgcctgcagcaagaagatgaccggcaagagcatccagcccgagaacctggaataccggatcatgctgagcgtgcacggctcccagcacagcggcatgatcgtgaacgacaccggccacgagacagacgagaaccgggccaaggtggaaatcacccccaacagccctagagccgaggccacactgggcggctttggatctctgggcctggactgcgagcctagaaccggcctggatttcagcgacctgtactacctgaccatgaacaacaagcactggctggtgcacaaagagtggttccacgacatccccctgccctggcatgctggcgctgatacaggcaccccccactggaacaacaaagaggctctggtggaattcaaggacgcccacgccaagcggcagaccgtggtggtgctgggatctcaggaaggcgccgtgcatacagctctggctggcgccctggaagccgaaatggatggcgccaaaggcagactgtcctccggccacctgaagtgccggctgaagatggacaagctgcggctgaagggcgtgtcctacagcctgtgtaccgccgccttcaccttcaccaagatccccgccgagacactgcacggcaccgtgactgtggaagtgcagtacgccggcaccgacggcccttgtaaagtgcctgctcagatggccgtggatatgcagaccctgacccccgtgggcagactgatcaccgccaaccctgtgatcaccgagagcaccgagaacagcaagatgatgctggaactggacccccccttcggcgactcctacatcgtgatcggcgtgggagagaagaagatcacccaccactggcacagatccggcagcaccatcggcaaggcctttgaggctacagtgcggggagccaagagaatggccgtgctgggcgataccgcctgggattttggctctgtgggcggagccctgaacagcctgggaaagggcatccaccagatcttcggcgctgccttcaagagcctgttcggcggcatgagctggttcagccagatcctgatcggcaccctgctcgtgtggctgggcctgaacaccaagaacggcagcatctccctgacctgcctggctctgggcggcgtgctgatctttctgagcacagccgtgtccgcctgataataggctggagcctcggtggccatgcttcttgccccttgggcctccccccagcccctcctccccttcctgcacccgtacccccgtggtctttgaataaagtctgagtgggcggc

SEQ ID NO: 120 - DNA, 2070 bp, Zika Virus
atggactggacctggatcctgttcctggtggccgctgccacaagagtgcacagcgtggaagtgaccagacggggcagcgcctactacatgtacctggacagaagcgacgccggcgaggccatcagctttccaaccaccctgggcatgaacaagtgctacatccagatcatggacctgggccacatgtgcgacgccaccatgagctacgagtgccccatgctggacgagggcgtggaacccgacgatgtggactgctggtgcaacaccaccagcacctgggtggtgtacggcacctgtcaccacaagaagggcgaagccagacggtccagacgggccgtgacactgcctagccacagcaccagaaagctgcagacccggtcccagacctggctggaaagcagagagtacaccaagcacctgatccgggtggaaaactggatcttccggaaccccggctttgccctggctgccgctgctattgcttggctgctgggcagcagcacctcccagaaagtgatctacctcgtgatgatcctgctgatcgcccctgcctacagcatccggtgtatcggcgtgtccaaccgggacttcgtggaaggcatgagcggcggcacatgggtggacgtggtgctggaacatggcggctgcgtgacagtgatggcccaggataagcccgccgtggacatcgagctcgtgaccaccaccgtgtccaatatggccgaagtgcggagctactgctacgaggccagcatcagcgacatggccagcgacagcagatgccctacacagggcgaggcctacctggataagcagtccgacacccagtacgtgtgcaagcggaccctggtggatagaggctggggcaatggctgcggcctgtttggcaagggcagcctcgtgacctgcgccaagttcgcctgcagcaagaagatgaccggcaagagcatccagcccgagaacctggaataccggatcatgctgagcgtgcacggctcccagcacagcggcatgatcgtgaacgacaccggccacgagacagacgagaaccgggccaaggtggaaatcacccccaacagccctagagccgaggccacactgggcggctttggatctctgggcctggactgcgagcctagaaccggcctggatttcagcgacctgtactacctgaccatgaacaacaagcactggctggtgcacaaagagtggttccacgacatccccctgccctggcatgctggcgctgatacaggcaccccccactggaacaacaaagaggctctggtggaattcaaggacgcccacgccaagcggcagaccgtggtggtgctgggatctcaggaaggcgccgtgcatacagctctggctggcgccctggaagccgaaatggatggcgccaaaggcagactgtcctccggccacctgaagtgccggctgaagatggacaagctgcggctgaagggcgtgtcctacagcctgtgtaccgccgccttcaccttcaccaagatccccgccgagacactgcacggcaccgtgactgtggaagtgcagtacgccggcaccgacggcccttgtaaagtgcctgctcagatggccgtggatatgcagaccctgacccccgtgggcagactgatcaccgccaaccctgtgatcaccgagagcaccgagaacagcaagatgatgctggaactggacccccccttcggcgactcctacatcgtgatcggcgtgggagagaagaagatcacccaccactggcacagatccggcagcaccatcggcaaggcctttgaggctacagtgcggggagccaagagaatggccgtgctgggcgataccgcctgggattttggctctgtgggcggagccctgaacagcctgggaaagggcatccaccagatcttcggcgctgccttcaagagcctgttcggcggcatgagctggttcagccagatcctgatcggcaccctgctcgtgtggctgggcctgaacaccaagaacggcagcatctccctgacctgcctggctctgggcggcgtgctgatctttctgagcacagccgtgtccgcc

SEQ ID NO: 121 - DNA, 2342 bp, Zika Virus
ggggaaataagagagaaaagaagagtaagaagaaatataagagccaccatggactggacctggatcctgttcctggtggccgctgccacaagagtgcacagcgtggaagtgaccagacggggcagcgcctactacatgtacctggacagaagcgacgccggcgaggccatcagctttccaaccaccctgggcatgaacaagtgctacatccagatcatggacctgggccacatgtgcgacgccaccatgagctacgagtgccccatgctggacgagggcgtggaacccgacgatgtggactgctggtgcaacaccaccagcacctgggtggtgtacggcacctgtcaccacaagaagggcgaagccagacggtccagacgggccgtgacactgcctagccacagcaccagaaagctgcagacccggtcccagacctggctggaaagcagagagtacaccaagcacctgatccgggtggaaaactggatcttccggaaccccggctttgccctggctgccgctgctattgcttggctgctgggcagcagcacctcccagaaagtgatctacctcgtgatgatcctgctgatcgcccctgcctacagcatccggtgtatcggcgtgtccaaccgggacttcgtggaaggcatgagcggcggcacatgggtggacgtggtgctggaacatggcggctgcgtgacagtgatggcccaggataagcccgccgtggacatcgagctcgtgaccaccaccgtgtccaatatggccgaagtgcggagctactgctacgaggccagcatcagcgacatggccagcgacagcagatgccctacacagggcgaggcctacctggataagcagtccgacacccagtacgtgtgcaagcggaccctggtggatagaggctggggcaatggctgcggcctgtttggcaagggcagcctcgtgacctgcgccaagttcgcctgcagcaagaagatgaccggcaagagcatccagcccgagaacctggaataccggatcatgctgagcgtgcacggctcccagcacagcggcatgatcgtgaacgacaccggccacgagacagacgagaaccgggccaaggtggaaatcacccccaacagccctagagccgaggccacactgggcggctttggatctctgggcctggactgcgagcctagaaccggcctggatttcagcgacctgtactacctgaccatgaacaacaagcactggctggtgcacaaagagtggttccacgacatccccctgccctggcatgctggcgctgatacaggcaccccccactggaacaacaaagaggctctggtggaattcaaggacgcccacgccaagcggcagaccgtggtggtgctgggatctcaggaaggcgccgtgcatacagctctggctggcgccctggaagccgaaatggatggcgccaaaggcagactgtcctccggccacctgaagtgccggctgaagatggacaagctgcggctgaagggcgtgtcctacagcctgtgtaccgccgccttcaccttcaccaagatccccgccgagacactgcacggcaccgtgactgtggaagtgcagtacgccggcaccgacggcccttgtaaagtgcctgctcagatggccgtggatatgcagaccctgacccccgtgggcagactgatcaccgccaaccctgtgatcaccgagagcaccgagaacagcaagatgatgctggaactggacccccccttcggcgactcctacatcgtgatcggcgtgggagagaagaagatcacccaccactggcacagatccggcagcaccatcggcaaggcctttgaggctacagtgcggggagccaagagaatggccgtgctgggcgataccgcctgggattttggctctgtgggcggagccctgaacagcctgggaaagggcatccaccagatcttcggcgctgccttcaagagcctgttcggcggcatgagctggttcagccagatcctgatcggcaccctgctcgtgtggctgggcctgaacaccaagaacggcagcatctccctgacctgcctggctctgggcggcgtgctgatctttctgagcacagccgtgtccgcctgataataggctggagcctcggtggccatgcttcttgccccttgggcctccccccagcccctcctccccttcctgcacccgtacccccgtggtctttgaataaagtctgagtgggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatctag

SEQ ID NO: 122 - DNA, 2272 bp, Zika Virus
tcaagcttttggaccctcgtacagaagctaatacgactcactatagggaaataagagagaaaagaagagtaagaagaaatataagagccaccatggactggacctggatcctgttcctggtggccgctgccacaagagtgcacagcaccagaagaggcagcgcctactacatgtacctggacagaagcgacgccggcgaggccatcagctttccaaccaccctgggcatgaacaagtgctacatccagatcatggacctgggccacatgtgcgacgccaccatgagctacgagtgccccatgctggacgagggcgtggaacccgacgatgtggactgctggtgcaacaccaccagcacctgggtggtgtacggcacctgtcaccacaagaagggcgaagccagacggtccagacgggccgtgacactgcctagccactccaccagaaagctgcagacccggtcccagacctggctggaaagcagagagtacaccaagcacctgatccgggtggaaaactggatcttccggaaccccggctttgccctggctgccgctgctattgcttggctgctgggcagcagcacctcccagaaagtgatctacctcgtgatgatcctgctgatcgcccctgcctacagcatccggtgtatcggcgtgtccaaccgggacttcgtggaaggcatgagcggcggcacatgggtggacgtggtgctggaacatggcggctgcgtgacagtgatggcccaggataagcccgccgtggacatcgagctcgtgaccaccaccgtgtccaatatggccgaagtgcggagctactgctacgaggccagcatcagcgacatggccagcgacagcagatgccctacacagggcgaggcctacctggataagcagtccgacacccagtacgtgtgcaagcggaccctggtggatagaggctggggcaatggctgcggcctgtttggcaagggcagcctcgtgacctgcgccaagttcgcctgcagcaagaagatgaccggcaagagcatccagcccgagaacctggaataccggatcatgctgagcgtgcacggctcccagcacagcggcatgatcgtgaacgacaccggccacgagacagacgagaaccgggccaaggtggaaatcacccccaacagccctagagccgaggccacactgggcggctttggatctctgggcctggactgcgagcctagaaccggcctggatttcagcgacctgtactacctgaccatgaacaacaagcactggctggtgcacaaagagtggttccacgacatccccctgccctggcatgctggcgctgatacaggcaccccccactggaacaacaaagaggctctggtggaattcaaggacgcccacgccaagcggcagaccgtggtggtgctgggatctcaggaaggcgccgtgcatacagctctggctggcgccctggaagccgaaatggatggcgccaaaggcagactgtcctccggccacctgaagtgccggctgaagatggacaagctgcggctgaagggcgtgtcctacagcctgtgtaccgccgccttcaccttcaccaagatccccgccgagacactgcacggcaccgtgactgtggaagtgcagtacgccggcaccgacggcccttgtaaagtgcctgctcagatggccgtggatatgcagaccctgacccccgtgggcagactgatcaccgccaaccctgtgatcaccgagagcaccgagaacagcaagatgatgctggaactggacccccccttcggcgactcctacatcgtgatcggcgtgggagagaagaagatcacccaccactggcacagatccggcagcaccatcggcaaggcctttgaggctacagtgcggggagccaagagaatggccgtgctgggcgataccgcctgggattttggctctgtgggcggagccctgaacagcctgggaaagggcatccaccagatcttcggagccgcctttaagagcctgttcggcggcatgagctggttcagccagatcctgatcggcaccctgctcgtgtggctgggcctgaacaccaagaacggcagcatctccctgacctgcctggctctgggcggcgtgctgatctttctgagcacagccgtgtccgcctgataataggctggagcctcggtggccatgcttcttgccccttgggcctccccccagcccctcctccccttcctgcacccgtacccccgtggtctttgaataaagtctgagtgggcggc

SEQ ID NO: 123 - DNA, 2061 bp, Zika Virus
atggactggacctggatcctgttcctggtggccgctgccacaagagtgcacagcaccagaagaggcagcgcctactacatgtacctggacagaagcgacgccggcgaggccatcagctttccaaccaccctgggcatgaacaagtgctacatccagatcatggacctgggccacatgtgcgacgccaccatgagctacgagtgccccatgctggacgagggcgtggaacccgacgatgtggactgctggtgcaacaccaccagcacctgggtggtgtacggcacctgtcaccacaagaagggcgaagccagacggtccagacgggccgtgacactgcctagccactccaccagaaagctgcagacccggtcccagacctggctggaaagcagagagtacaccaagcacctgatccgggtggaaaactggatcttccggaaccccggctttgccctggctgccgctgctattgcttggctgctgggcagcagcacctcccagaaagtgatctacctcgtgatgatcctgctgatcgcccctgcctacagcatccggtgtatcggcgtgtccaaccgggacttcgtggaaggcatgagcggcggcacatgggtggacgtggtgctggaacatggcggctgcgtgacagtgatggcccaggataagcccgccgtggacatcgagctcgtgaccaccaccgtgtccaatatggccgaagtgcggagctactgctacgaggccagcatcagcgacatggccagcgacagcagatgccctacacagggcgaggcctacctggataagcagtccgacacccagtacgtgtgcaagcggaccctggtggatagaggctggggcaatggctgcggcctgtttggcaagggcagcctcgtgacctgcgccaagttcgcctgcagcaagaagatgaccggcaagagcatccagcccgagaacctggaataccggatcatgctgagcgtgcacggctcccagcacagcggcatgatcgtgaacgacaccggccacgagacagacgagaaccgggccaaggtggaaatcacccccaacagccctagagccgaggccacactgggcggctttggatctctgggcctggactgcgagcctagaaccggcctggatttcagcgacctgtactacctgaccatgaacaacaagcactggctggtgcacaaagagtggttccacgacatccccctgccctggcatgctggcgctgatacaggcaccccccactggaacaacaaagaggctctggtggaattcaaggacgcccacgccaagcggcagaccgtggtggtgctgggatctcaggaaggcgccgtgcatacagctctggctggcgccctggaagccgaaatggatggcgccaaaggcagactgtcctccggccacctgaagtgccggctgaagatggacaagctgcggctgaagggcgtgtcctacagcctgtgtaccgccgccttcaccttcaccaagatccccgccgagacactgcacggcaccgtgactgtggaagtgcagtacgccggcaccgacggcccttgtaaagtgcctgctcagatggccgtggatatgcagaccctgacccccgtgggcagactgatcaccgccaaccctgtgatcaccgagagcaccgagaacagcaagatgatgctggaactggacccccccttcggcgactcctacatcgtgatcggcgtgggagagaagaagatcacccaccactggcacagatccggcagcaccatcggcaaggcctttgaggctacagtgcggggagccaagagaatggccgtgctgggcgataccgcctgggattttggctctgtgggcggagccctgaacagcctgggaaagggcatccaccagatcttcggagccgcctttaagagcctgttcggcggcatgagctggttcagccagatcctgatcggcaccctgctcgtgtggctgggcctgaacaccaagaacggcagcatctccctgacctgcctggctctgggcggcgtgctgatctttctgagcacagccgtgtccgcc

SEQ ID NO: 124 - DNA, 2333 bp, Zika Virus
ggggaaataagagagaaaagaagagtaagaagaaatataagagccaccatggactggacctggatcctgttcctggtggccgctgccacaagagtgcacagcaccagaagaggcagcgcctactacatgtacctggacagaagcgacgccggcgaggccatcagctttccaaccaccctgggcatgaacaagtgctacatccagatcatggacctgggccacatgtgcgacgccaccatgagctacgagtgccccatgctggacgagggcgtggaacccgacgatgtggactgctggtgcaacaccaccagcacctgggtggtgtacggcacctgtcaccacaagaagggcgaagccagacggtccagacgggccgtgacactgcctagccactccaccagaaagctgcagacccggtcccagacctggctggaaagcagagagtacaccaagcacctgatccgggtggaaaactggatcttccggaaccccggctttgccctggctgccgctgctattgcttggctgctgggcagcagcacctcccagaaagtgatctacctcgtgatgatcctgctgatcgcccctgcctacagcatccggtgtatcggcgtgtccaaccgggacttcgtggaaggcatgagcggcggcacatgggtggacgtggtgctggaacatggcggctgcgtgacagtgatggcccaggataagcccgccgtggacatcgagctcgtgaccaccaccgtgtccaatatggccgaagtgcggagctactgctacgaggccagcatcagcgacatggccagcgacagcagatgccctacacagggcgaggcctacctggataagcagtccgacacccagtacgtgtgcaagcggaccctggtggatagaggctggggcaatggctgcggcctgtttggcaagggcagcctcgtgacctgcgccaagttcgcctgcagcaagaagatgaccggcaagagcatccagcccgagaacctggaataccggatcatgctgagcgtgcacggctcccagcacagcggcatgatcgtgaacgacaccggccacgagacagacgagaaccgggccaaggtggaaatcacccccaacagccctagagccgaggccacactgggcggctttggatctctgggcctggactgcgagcctagaaccggcctggatttcagcgacctgtactacctgaccatgaacaacaagcactggctggtgcacaaagagtggttccacgacatccccctgccctggcatgctggcgctgatacaggcaccccccactggaacaacaaagaggctctggtggaattcaaggacgcccacgccaagcggcagaccgtggtggtgctgggatctcaggaaggcgccgtgcatacagctctggctggcgccctggaagccgaaatggatggcgccaaaggcagactgtcctccggccacctgaagtgccggctgaagatggacaagctgcggctgaagggcgtgtcctacagcctgtgtaccgccgccttcaccttcaccaagatccccgccgagacactgcacggcaccgtgactgtggaagtgcagtacgccggcaccgacggcccttgtaaagtgcctgctcagatggccgtggatatgcagaccctgacccccgtgggcagactgatcaccgccaaccctgtgatcaccgagagcaccgagaacagcaagatgatgctggaactggacccccccttcggcgactcctacatcgtgatcggcgtgggagagaagaagatcacccaccactggcacagatccggcagcaccatcggcaaggcctttgaggctacagtgcggggagccaagagaatggccgtgctgggcgataccgcctgggattttggctctgtgggcggagccctgaacagcctgggaaagggcatccaccagatcttcggagccgcctttaagagcctgttcggcggcatgagctggttcagccagatcctgatcggcaccctgctcgtgtggctgggcctgaacaccaagaacggcagcatctccctgacctgcctggctctgggcggcgtgctgatctttctgagcacagccgtgtccgcctgataataggctggagcctcggtggccatgcttcttgccccttgggcctccccccagcccctcctccccttcctgcacccgtacccccgtggtctttgaataaagtctgagtgggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatctag

SEQ ID NO: 125 - DNA, 2287 bp, Zika Virus
tcaagcttttggaccctcgtacagaagctaatacgactcactatagggaaataagagagaaaagaagagtaagaagaaatataagagccaccatggaaacccctgcccagctgctgttcctgctgctgctgtggctgcctgataccaccggcgtggaagtgaccagaagaggcagcgcctactacatgtacctggacagaagcgacgccggcgaggccatcagctttccaaccaccctgggcatgaacaagtgctacatccagatcatggacctgggccacatgtgcgacgccaccatgagctacgagtgccccatgctggacgagggcgtggaacccgacgatgtggactgctggtgcaacaccaccagcacctgggtggtgtacggcacctgtcaccacaagaagggcgaagccagacggtccagacgggccgtgacactgcctagccactccaccagaaagctgcagacccggtcccagacctggctggaaagcagagagtacaccaagcacctgatccgggtggaaaactggatcttccggaaccccggctttgccctggccgctgctgctattgcttggctgctgggcagcagcacctcccagaaagtgatctacctcgtgatgatcctgctgatcgcccctgcctacagcatccggtgtatcggcgtgtccaaccgggacttcgtggaaggcatgagcggcggcacatgggtggacgtggtgctggaacatggcggctgcgtgacagtgatggcccaggataagcccgccgtggacatcgagctcgtgaccaccaccgtgtccaatatggccgaagtgcggagctactgctacgaggccagcatcagcgacatggccagcgacagcagatgccctacacagggcgaggcctacctggataagcagtccgacacccagtacgtgtgcaagcggaccctggtggatagaggctggggcaatggctgcggcctgtttggcaagggcagcctcgtgacctgcgccaagttcgcctgcagcaagaagatgaccggcaagagcatccagcccgagaacctggaataccggatcatgctgagcgtgcacggcagccagcactccggcatgatcgtgaacgacaccggccacgagacagacgagaaccgggccaaggtggaaatcacccccaacagccctagagccgaggccacactgggcggctttggatctctgggcctggactgcgagcctagaaccggcctggatttcagcgacctgtactacctgaccatgaacaacaagcactggctggtgcacaaagagtggttccacgacatccccctgccctggcatgccggcgctgatacaggcacaccccactggaacaacaaagaggctctggtggaattcaaggacgcccacgccaagcggcagaccgtggtggtgctgggatctcaggaaggcgccgtgcatacagctctggctggcgccctggaagccgaaatggatggcgccaaaggcagactgtccagcggccacctgaagtgccggctgaagatggacaagctgcggctgaagggcgtgtcctacagcctgtgtaccgccgccttcaccttcaccaagatccccgccgagacactgcacggcaccgtgactgtggaagtgcagtacgccggcaccgacggcccttgtaaagtgcctgctcagatggccgtggatatgcagaccctgacccccgtgggcagactgatcaccgccaaccctgtgatcaccgagagcaccgagaacagcaagatgatgctggaactggacccccccttcggcgactcctacatcgtgatcggcgtgggagagaagaagatcacccaccactggcaccgcagcggcagcacaatcggcaaggcctttgaagccacagtgcggggagccaagagaatggccgtgctgggagataccgcctgggactttggctctgtgggcggagccctgaactctctgggcaagggaatccaccagatcttcggagccgcctttaagagcctgttcggcggcatgagctggttcagccagatcctgatcggcaccctgctcgtgtggctgggcctgaacaccaagaacggcagcatctccctgacctgcctggctctgggaggcgtgctgatctttctgagcaccgccgtgtctgcctgataataggctggagcctcggtggccatgcttcttgccccttgggcctccccccagcccctcctccccttcctgcacccgtacccccgtggtctttgaataaagtctgagtgggcggc

SEQ ID NO: 126 - DNA, 2076 bp, Zika Virus
atggaaacccctgcccagctgctgttcctgctgctgctgtggctgcctgataccaccggcgtggaagtgaccagaagaggcagcgcctactacatgtacctggacagaagcgacgccggcgaggccatcagctttccaaccaccctgggcatgaacaagtgctacatccagatcatggacctgggccacatgtgcgacgccaccatgagctacgagtgccccatgctggacgagggcgtggaacccgacgatgtggactgctggtgcaacaccaccagcacctgggtggtgtacggcacctgtcaccacaagaagggcgaagccagacggtccagacgggccgtgacactgcctagccactccaccagaaagctgcagacccggtcccagacctggctggaaagcagagagtacaccaagcacctgatccgggtggaaaactggatcttccggaaccccggctttgccctggccgctgctgctattgcttggctgctgggcagcagcacctcccagaaagtgatctacctcgtgatgatcctgctgatcgcccctgcctacagcatccggtgtatcggcgtgtccaaccgggacttcgtggaaggcatgagcggcggcacatgggtggacgtggtgctggaacatggcggctgcgtgacagtgatggcccaggataagcccgccgtggacatcgagctcgtgaccaccaccgtgtccaatatggccgaagtgcggagctactgctacgaggccagcatcagcgacatggccagcgacagcagatgccctacacagggcgaggcctacctggataagcagtccgacacccagtacgtgtgcaagcggaccctggtggatagaggctggggcaatggctgcggcctgtttggcaagggcagcctcgtgacctgcgccaagttcgcctgcagcaagaagatgaccggcaagagcatccagcccgagaacctggaataccggatcatgctgagcgtgcacggcagccagcactccggcatgatcgtgaacgacaccggccacgagacagacgagaaccgggccaaggtggaaatcacccccaacagccctagagccgaggccacactgggcggctttggatctctgggcctggactgcgagcctagaaccggcctggatttcagcgacctgtactacctgaccatgaacaacaagcactggctggtgcacaaagagtggttccacgacatccccctgccctggcatgccggcgctgatacaggcacaccccactggaacaacaaagaggctctggtggaattcaaggacgcccacgccaagcggcagaccgtggtggtgctgggatctcaggaaggcgccgtgcatacagctctggctggcgccctggaagccgaaatggatggcgccaaaggcagactgtccagcggccacctgaagtgccggctgaagatggacaagctgcggctgaagggcgtgtcctacagcctgtgtaccgccgccttcaccttcaccaagatccccgccgagacactgcacggcaccgtgactgtggaagtgcagtacgccggcaccgacggcccttgtaaagtgcctgctcagatggccgtggatatgcagaccctgacccccgtgggcagactgatcaccgccaaccctgtgatcaccgagagcaccgagaacagcaagatgatgctggaactggacccccccttcggcgactcctacatcgtgatcggcgtgggagagaagaagatcacccaccactggcaccgcagcggcagcacaatcggcaaggcctttgaagccacagtgcggggagccaagagaatggccgtgctgggagataccgcctgggactttggctctgtgggcggagccctgaactctctgggcaagggaatccaccagatcttcggagccgcctttaagagcctgttcggcggcatgagctggttcagccagatcctgatcggcaccctgctcgtgtggctgggcctgaacaccaagaacggcagcatctccctgacctgcctggctctgggaggcgtgctgatctttctgagcaccgccgtgtctgcc

SEQ ID NO: 127 - DNA, 2348 bp, Zika Virus
ggggaaataagagagaaaagaagagtaagaagaaatataagagccaccatggaaacccctgcccagctgctgttcctgctgctgctgtggctgcctgataccaccggcgtggaagtgaccagaagaggcagcgcctactacatgtacctggacagaagcgacgccggcgaggccatcagctttccaaccaccctgggcatgaacaagtgctacatccagatcatggacctgggccacatgtgcgacgccaccatgagctacgagtgccccatgctggacgagggcgtggaacccgacgatgtggactgctggtgcaacaccaccagcacctgggtggtgtacggcacctgtcaccacaagaagggcgaagccagacggtccagacgggccgtgacactgcctagccactccaccagaaagctgcagacccggtcccagacctggctggaaagcagagagtacaccaagcacctgatccgggtggaaaactggatcttccggaaccccggctttgccctggccgctgctgctattgcttggctgctgggcagcagcacctcccagaaagtgatctacctcgtgatgatcctgctgatcgcccctgcctacagcatccggtgtatcggcgtgtccaaccgggacttcgtggaaggcatgagcggcggcacatgggtggacgtggtgctggaacatggcggctgcgtgacagtgatggcccaggataagcccgccgtggacatcgagctcgtgaccaccaccgtgtccaatatggccgaagtgcggagctactgctacgaggccagcatcagcgacatggccagcgacagcagatgccctacacagggcgaggcctacctggataagcagtccgacacccagtacgtgtgcaagcggaccctggtggatagaggctggggcaatggctgcggcctgtttggcaagggcagcctcgtgacctgcgccaagttcgcctgcagcaagaagatgaccggcaagagcatccagcccgagaacctggaataccggatcatgctgagcgtgcacggcagccagcactccggcatgatcgtgaacgacaccggccacgagacagacgagaaccgggccaaggtggaaatcacccccaacagccctagagccgaggccacactgggcggctttggatctctgggcctggactgcgagcctagaaccggcctggatttcagcgacctgtactacctgaccatgaacaacaagcactggctggtgcacaaagagtggttccacgacatccccctgccctggcatgccggcgctgatacaggcacaccccactggaacaacaaagaggctctggtggaattcaaggacgcccacgccaagcggcagaccgtggtggtgctgggatctcaggaaggcgccgtgcatacagctctggctggcgccctggaagccgaaatggatggcgccaaaggcagactgtccagcggccacctgaagtgccggctgaagatggacaagctgcggctgaagggcgtgtcctacagcctgtgtaccgccgccttcaccttcaccaagatccccgccgagacactgcacggcaccgtgactgtggaagtgcagtacgccggcaccgacggcccttgtaaagtgcctgctcagatggccgtggatatgcagaccctgacccccgtgggcagactgatcaccgccaaccctgtgatcaccgagagcaccgagaacagcaagatgatgctggaactggacccccccttcggcgactcctacatcgtgatcggcgtgggagagaagaagatcacccaccactggcaccgcagcggcagcacaatcggcaaggcctttgaagccacagtgcggggagccaagagaatggccgtgctgggagataccgcctgggactttggctctgtgggcggagccctgaactctctgggcaagggaatccaccagatcttcggagccgcctttaagagcctgttcggcggcatgagctggttcagccagatcctgatcggcaccctgctcgtgtggctgggcctgaacaccaagaacggcagcatctccctgacctgcctggctctgggaggcgtgctgatctttctgagcaccgccgtgtctgcctgataataggctggagcctcggtggccatgcttcttgccccttgggcctccccccagcccctcctccccttcctgcacccgtacccccgtggtctttgaataaagtctgagtgggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatctag

SEQ ID NO: 128 - DNA, 2278 bp, Zika Virus
tcaagcttttggaccctcgtacagaagctaatacgactcactatagggaaataagagagaaaagaagagtaagaagaaatataagagccaccatggaaacccctgcccagctgctgttcctgctgctgctgtggctgcctgataccaccggcaccagaagaggcagcgcctactacatgtacctggacagaagcgacgccggcgaggccatcagctttccaaccaccctgggcatgaacaagtgctacatccagatcatggacctgggccacatgtgcgacgccaccatgagctacgagtgccccatgctggacgagggcgtggaacccgacgatgtggactgctggtgcaacaccaccagcacctgggtggtgtacggcacctgtcaccacaagaagggcgaagccagacggtccagacgggccgtgacactgcctagccactccaccagaaagctgcagacccggtcccagacctggctggaaagcagagagtacaccaagcacctgatccgggtggaaaactggatcttccggaaccccggctttgccctggccgctgctgctattgcttggctgctgggcagcagcacctcccagaaagtgatctacctcgtgatgatcctgctgatcgcccctgcctacagcatccggtgtatcggcgtgtccaaccgggacttcgtggaaggcatgagcggcggcacatgggtggacgtggtgctggaacatggcggctgcgtgacagtgatggcccaggataagcccgccgtggacatcgagctcgtgaccaccaccgtgtccaatatggccgaagtgcggagctactgctacgaggccagcatcagcgacatggccagcgacagcagatgccctacacagggcgaggcctacctggataagcagtccgacacccagtacgtgtgcaagcggaccctggtggatagaggctggggcaatggctgcggcctgtttggcaagggcagcctcgtgacctgcgccaagttcgcctgcagcaagaagatgaccggcaagagcatccagcccgagaacctggaataccggatcatgctgagcgtgcacggcagccagcactccggcatgatcgtgaacgacaccggccacgagacagacgagaaccgggccaaggtggaaatcacccccaacagccctagagccgaggccacactgggcggctttggatctctgggcctggactgcgagcctagaaccggcctggatttcagcgacctgtactacctgaccatgaacaacaagcactggctggtgcacaaagagtggttccacgacatccccctgccctggcatgccggcgctgatacaggcacaccccactggaacaacaaagaggctctggtggaattcaaggacgcccacgccaagcggcagaccgtggtggtgctgggatctcaggaaggcgccgtgcatacagctctggctggcgccctggaagccgaaatggatggcgccaaaggcagactgtccagcggccacctgaagtgccggctgaagatggacaagctgcggctgaagggcgtgtcctacagcctgtgtaccgccgccttcaccttcaccaagatccccgccgagacactgcacggcaccgtgactgtggaagtgcagtacgccggcaccgacggcccttgtaaagtgcctgctcagatggccgtggatatgcagaccctgacccccgtgggcagactgatcaccgccaaccctgtgatcaccgagagcaccgagaacagcaagatgatgctggaactggacccccccttcggcgactcctacatcgtgatcggcgtgggagagaagaagatcacccaccactggcaccgcagcggcagcacaatcggcaaggcctttgaagccacagtgcggggagccaagagaatggccgtgctgggagataccgcctgggactttggctctgtgggcggagccctgaactctctgggcaagggaatccaccagatcttcggagccgcctttaagagcctgttcggcggcatgagctggttcagccagatcctgatcggcaccctgctcgtgtggctgggcctgaacaccaagaacggcagcatctccctgacctgcctggctctgggaggcgtgctgatctttctgagcaccgccgtgtctgcctgataataggctggagcctcggtggccatgcttcttgccccttgggcctccccccagcccctcctccccttcctgcacccgtacccccgtggtctttgaataaagtctgagtgggcggc

SEQ ID NO: 129 - DNA, 2067 bp, Zika Virus
atggaaacccctgcccagctgctgttcctgctgctgctgtggctgcctgataccaccggcaccagaagaggcagcgcctactacatgtacctggacagaagcgacgccggcgaggccatcagctttccaaccaccctgggcatgaacaagtgctacatccagatcatggacctgggccacatgtgcgacgccaccatgagctacgagtgccccatgctggacgagggcgtggaacccgacgatgtggactgctggtgcaacaccaccagcacctgggtggtgtacggcacctgtcaccacaagaagggcgaagccagacggtccagacgggccgtgacactgcctagccactccaccagaaagctgcagacccggtcccagacctggctggaaagcagagagtacaccaagcacctgatccgggtggaaaactggatcttccggaaccccggctttgccctggccgctgctgctattgcttggctgctgggcagcagcacctcccagaaagtgatctacctcgtgatgatcctgctgatcgcccctgcctacagcatccggtgtatcggcgtgtccaaccgggacttcgtggaaggcatgagcggcggcacatgggtggacgtggtgctggaacatggcggctgcgtgacagtgatggcccaggataagcccgccgtggacatcgagctcgtgaccaccaccgtgtccaatatggccgaagtgcggagctactgctacgaggccagcatcagcgacatggccagcgacagcagatgccctacacagggcgaggcctacctggataagcagtccgacacccagtacgtgtgcaagcggaccctggtggatagaggctggggcaatggctgcggcctgtttggcaagggcagcctcgtgacctgcgccaagttcgcctgcagcaagaagatgaccggcaagagcatccagcccgagaacctggaataccggatcatgctgagcgtgcacggcagccagcactccggcatgatcgtgaacgacaccggccacgagacagacgagaaccgggccaaggtggaaatcacccccaacagccctagagccgaggccacactgggcggctttggatctctgggcctggactgcgagcctagaaccggcctggatttcagcgacctgtactacctgaccatgaacaacaagcactggctggtgcacaaagagtggttccacgacatccccctgccctggcatgccggcgctgatacaggcacaccccactggaacaacaaagaggctctggtggaattcaaggacgcccacgccaagcggcagaccgtggtggtgctgggatctcaggaaggcgccgtgcatacagctctggctggcgccctggaagccgaaatggatggcgccaaaggcagactgtccagcggccacctgaagtgccggctgaagatggacaagctgcggctgaagggcgtgtcctacagcctgtgtaccgccgccttcaccttcaccaagatccccgccgagacactgcacggcaccgtgactgtggaagtgcagtacgccggcaccgacggcccttgtaaagtgcctgctcagatggccgtggatatgcagaccctgacccccgtgggcagactgatcaccgccaaccctgtgatcaccgagagcaccgagaacagcaagatgatgctggaactggacccccccttcggcgactcctacatcgtgatcggcgtgggagagaagaagatcacccaccactggcaccgcagcggcagcacaatcggcaaggcctttgaagccacagtgcggggagccaagagaatggccgtgctgggagataccgcctgggactttggctctgtgggcggagccctgaactctctgggcaagggaatccaccagatcttcggagccgcctttaagagcctgttcggcggcatgagctggttcagccagatcctgatcggcaccctgctcgtgtggctgggcctgaacaccaagaacggcagcatctccctgacctgcctggctctgggaggcgtgctgatctttctgagcaccgccgtgtctgcc

SEQ ID NO: 130 - DNA, 2339 bp, Zika Virus
ggggaaataagagagaaaagaagagtaagaagaaatataagagccaccatggaaacccctgcccagctgctgttcctgctgctgctgtggctgcctgataccaccggcaccagaagaggcagcgcctactacatgtacctggacagaagcgacgccggcgaggccatcagctttccaaccaccctgggcatgaacaagtgctacatccagatcatggacctgggccacatgtgcgacgccaccatgagctacgagtgccccatgctggacgagggcgtggaacccgacgatgtggactgctggtgcaacaccaccagcacctgggtggtgtacggcacctgtcaccacaagaagggcgaagccagacggtccagacgggccgtgacactgcctagccactccaccagaaagctgcagacccggtcccagacctggctggaaagcagagagtacaccaagcacctgatccgggtggaaaactggatcttccggaaccccggctttgccctggccgctgctgctattgcttggctgctgggcagcagcacctcccagaaagtgatctacctcgtgatgatcctgctgatcgcccctgcctacagcatccggtgtatcggcgtgtccaaccgggacttcgtggaaggcatgagcggcggcacatgggtggacgtggtgctggaacatggcggctgcgtgacagtgatggcccaggataagcccgccgtggacatcgagctcgtgaccaccaccgtgtccaatatggccgaagtgcggagctactgctacgaggccagcatcagcgacatggccagcgacagcagatgccctacacagggcgaggcctacctggataagcagtccgacacccagtacgtgtgcaagcggaccctggtggatagaggctggggcaatggctgcggcctgtttggcaagggcagcctcgtgacctgcgccaagttcgcctgcagcaagaagatgaccggcaagagcatccagcccgagaacctggaataccggatcatgctgagcgtgcacggcagccagcactccggcatgatcgtgaacgacaccggccacgagacagacgagaaccgggccaaggtggaaatcacccccaacagccctagagccgaggccacactgggcggctttggatctctgggcctggactgcgagcctagaaccggcctggatttcagcgacctgtactacctgaccatgaacaacaagcactggctggtgcacaaagagtggttccacgacatccccctgccctggcatgccggcgctgatacaggcacaccccactggaacaacaaagaggctctggtggaattcaaggacgcccacgccaagcggcagaccgtggtggtgctgggatctcaggaaggcgccgtgcatacagctctggctggcgccctggaagccgaaatggatggcgccaaaggcagactgtccagcggccacctgaagtgccggctgaagatggacaagctgcggctgaagggcgtgtcctacagcctgtgtaccgccgccttcaccttcaccaagatccccgccgagacactgcacggcaccgtgactgtggaagtgcagtacgccggcaccgacggcccttgtaaagtgcctgctcagatggccgtggatatgcagaccctgacccccgtgggcagactgatcaccgccaaccctgtgatcaccgagagcaccgagaacagcaagatgatgctggaactggacccccccttcggcgactcctacatcgtgatcggcgtgggagagaagaagatcacccaccactggcaccgcagcggcagcacaatcggcaaggcctttgaagccacagtgcggggagccaagagaatggccgtgctgggagataccgcctgggactttggctctgtgggcggagccctgaactctctgggcaagggaatccaccagatcttcggagccgcctttaagagcctgttcggcggcatgagctggttcagccagatcctgatcggcaccctgctcgtgtggctgggcctgaacaccaagaacggcagcatctccctgacctgcctggctctgggaggcgtgctgatctttctgagcaccgccgtgtctgcctgataataggctggagcctcggtggccatgcttcttgccccttgggcctccccccagcccctcctccccttcctgcacccgtacccccgtggtctttgaataaagtctgagtgggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatctag

SEQ ID NO: 131 - DNA, 1783 bp, Zika Virus
tcaagcttttggaccctcgtacagaagctaatacgactcactatagggaaataagagagaaaagaagagtaagaagaaatataagagccaccatggaaacccctgcccagctgctgttcctgctgctgctgtggctgcctgacaccaccggcatcagatgcatcggcgtgtccaaccgggacttcgtggaaggcatgagcggcggcacatgggtggacgtggtgctggaacatggcggctgcgtgacagtgatggcccaggataagcccgccgtggacatcgagctcgtgaccaccaccgtgtccaatatggccgaagtgcggagctactgctacgaggccagcatcagcgacatggccagcgacagcagatgccctacacagggcgaggcctacctggacaagcagagcgacacccagtacgtgtgcaagcggaccctggtggatagaggctggggcaatggctgcggcctgtttggcaagggcagcctcgtgacctgcgccaagttcgcctgcagcaagaagatgaccggcaagagcatccagcccgagaacctggaataccggatcatgctgagcgtgcacggcagccagcactccggcatgatcgtgaacgacaccggccacgagacagacgagaaccgggccaaggtggaaatcacccccaacagccctagagccgaggccacactgggcggctttggatctctgggcctggactgcgagcctagaaccggcctggatttcagcgacctgtactacctgaccatgaacaacaagcactggctggtgcacaaagagtggttccacgacatccccctgccctggcatgccggcgctgatacaggcacaccccactggaacaacaaagaggctctggtggaattcaaggacgcccacgccaagcggcagaccgtggtggtgctgggatctcaggaaggcgccgtgcatacagctctggctggcgccctggaagccgaaatggatggcgccaaaggcagactgagcagcggccacctgaagtgccggctgaagatggacaagctgcggctgaagggcgtgtcctacagcctgtgtaccgccgccttcaccttcaccaagatccccgccgagacactgcacggcaccgtgactgtggaagtgcagtacgccggcaccgacggcccttgtaaagtgcctgctcagatggccgtggatatgcagaccctgacccccgtgggcaggctgatcacagccaaccctgtgatcaccgagagcaccgagaacagcaagatgatgctggaactggacccccccttcggcgactcctacatcgtgatcggcgtgggagagaagaagatcacccaccactggcacagaagcggcagcaccatcggcaaggcctttgaggctacagtgcggggagccaagagaatggccgtgctgggagataccgcctgggactttggctctgtgggcggagccctgaactctctgggcaagggaatccaccagatcttcggcgctgccttcaagagcctgttcggcggcatgagctggttcagccagatcctgatcggcaccctgctcgtgtggctgggcctgaacaccaagaacggcagcatctccctgacctgcctggctctgggaggcgtgctgatctttctgagcaccgccgtgtctgcctgataataggctggagcctcggtggccatgcttcttgccccttgggcctccccccagcccctcctccccttcctgcacccgtacccccgtggtctttgaataaagtctgagtgggcggc

SEQ ID NO: 132 - DNA, 1572 bp, Zika Virus
atggaaacccctgcccagctgctgttcctgctgctgctgtggctgcctgacaccaccggcatcagatgcatcggcgtgtccaaccgggacttcgtggaaggcatgagcggcggcacatgggtggacgtggtgctggaacatggcggctgcgtgacagtgatggcccaggataagcccgccgtggacatcgagctcgtgaccaccaccgtgtccaatatggccgaagtgcggagctactgctacgaggccagcatcagcgacatggccagcgacagcagatgccctacacagggcgaggcctacctggacaagcagagcgacacccagtacgtgtgcaagcggaccctggtggatagaggctggggcaatggctgcggcctgtttggcaagggcagcctcgtgacctgcgccaagttcgcctgcagcaagaagatgaccggcaagagcatccagcccgagaacctggaataccggatcatgctgagcgtgcacggcagccagcactccggcatgatcgtgaacgacaccggccacgagacagacgagaaccgggccaaggtggaaatcacccccaacagccctagagccgaggccacactgggcggctttggatctctgggcctggactgcgagcctagaaccggcctggatttcagcgacctgtactacctgaccatgaacaacaagcactggctggtgcacaaagagtggttccacgacatccccctgccctggcatgccggcgctgatacaggcacaccccactggaacaacaaagaggctctggtggaattcaaggacgcccacgccaagcggcagaccgtggtggtgctgggatctcaggaaggcgccgtgcatacagctctggctggcgccctggaagccgaaatggatggcgccaaaggcagactgagcagcggccacctgaagtgccggctgaagatggacaagctgcggctgaagggcgtgtcctacagcctgtgtaccgccgccttcaccttcaccaagatccccgccgagacactgcacggcaccgtgactgtggaagtgcagtacgccggcaccgacggcccttgtaaagtgcctgctcagatggccgtggatatgcagaccctgacccccgtgggcaggctgatcacagccaaccctgtgatcaccgagagcaccgagaacagcaagatgatgctggaactggacccccccttcggcgactcctacatcgtgatcggcgtgggagagaagaagatcacccaccactggcacagaagcggcagcaccatcggcaaggcctttgaggctacagtgcggggagccaagagaatggccgtgctgggagataccgcctgggactttggctctgtgggcggagccctgaactctctgggcaagggaatccaccagatcttcggcgctgccttcaagagcctgttcggcggcatgagctggttcagccagatcctgatcggcaccctgctcgtgtggctgggcctgaacaccaagaacggcagcatctccctgacctgcctggctctgggaggcgtgctgatctttctgagcaccgccgtgtctgcc

SEQ ID NO: 133 - DNA, 1844 bp, Zika Virus
ggggaaataagagagaaaagaagagtaagaagaaatataagagccaccatggaaacccctgcccagctgctgttcctgctgctgctgtggctgcctgacaccaccggcatcagatgcatcggcgtgtccaaccgggacttcgtggaaggcatgagcggcggcacatgggtggacgtggtgctggaacatggcggctgcgtgacagtgatggcccaggataagcccgccgtggacatcgagctcgtgaccaccaccgtgtccaatatggccgaagtgcggagctactgctacgaggccagcatcagcgacatggccagcgacagcagatgccctacacagggcgaggcctacctggacaagcagagcgacacccagtacgtgtgcaagcggaccctggtggatagaggctggggcaatggctgcggcctgtttggcaagggcagcctcgtgacctgcgccaagttcgcctgcagcaagaagatgaccggcaagagcatccagcccgagaacctggaataccggatcatgctgagcgtgcacggcagccagcactccggcatgatcgtgaacgacaccggccacgagacagacgagaaccgggccaaggtggaaatcacccccaacagccctagagccgaggccacactgggcggctttggatctctgggcctggactgcgagcctagaaccggcctggatttcagcgacctgtactacctgaccatgaacaacaagcactggctggtgcacaaagagtggttccacgacatccccctgccctggcatgccggcgctgatacaggcacaccccactggaacaacaaagaggctctggtggaattcaaggacgcccacgccaagcggcagaccgtggtggtgctgggatctcaggaaggcgccgtgcatacagctctggctggcgccctggaagccgaaatggatggcgccaaaggcagactgagcagcggccacctgaagtgccggctgaagatggacaagctgcggctgaagggcgtgtcctacagcctgtgtaccgccgccttcaccttcaccaagatccccgccgagacactgcacggcaccgtgactgtggaagtgcagtacgccggcaccgacggcccttgtaaagtgcctgctcagatggccgtggatatgcagaccctgacccccgtgggcaggctgatcacagccaaccctgtgatcaccgagagcaccgagaacagcaagatgatgctggaactggacccccccttcggcgactcctacatcgtgatcggcgtgggagagaagaagatcacccaccactggcacagaagcggcagcaccatcggcaaggcctttgaggctacagtgcggggagccaagagaatggccgtgctgggagataccgcctgggactttggctctgtgggcggagccctgaactctctgggcaagggaatccaccagatcttcggcgctgccttcaagagcctgttcggcggcatgagctggttcagccagatcctgatcggcaccctgctcgtgtggctgggcctgaacaccaagaacggcagcatctccctgacctgcctggctctgggaggcgtgctgatctttctgagcaccgccgtgtctgcctgataataggctggagcctcggtggccatgcttcttgccccttgggcctccccccagcccctcctccccttcctgcacccgtacccccgtggtctttgaataaagtctgagtgggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatctag

SEQ ID NO: 134 - DNA, 2088 bp, Artificial Sequence
  Synthetic Polynucleotide
atgctgggcagcaacagcggccagagagtggtgttcaccatcctgctgctgctggtggcccctgcctacagcgccgaagtgacaagaagaggcagcgcctactacatgtacctggaccggaacgatgccggcgaggccatcagctttccaaccaccctgggcatgaacaagtgctacatccagatcatggacctgggccacatgtgcgacgccaccatgagctacgagtgccccatgctggacgagggcgtggaacccgacgatgtggactgctggtgcaataccaccagcacctgggtggtgtacggcacctgtcaccacaagaagggcgaagccagacggtccagacgggccgtgacactgcctagccacagcaccagaaagctgcagacccggtcccagacctggctggaaagcagagagtacaccaagcacctgatccgggtggaaaactggatcttccggaaccccggctttgccctggctgccgctgctattgcttggctgctgggctctagcaccagccagaaagtgatctacctcgtgatgatcctgctgatcgccccagcctactccatccggtgtatcggcgtgtccaaccgggacttcgtggaaggcatgagcggcggcacatgggtggacgtggtgctggaacatggcggctgcgtgacagtgatggcccaggacaagcccaccgtggacatcgagctcgtgaccaccaccgtgtccaatatggccgaagtgcggagctactgctacgaggccagcatcagcgacatggccagcgacagcagatgccctacacagggcgaggcctacctggacaagcagtccgacacccagtacgtgtgcaagcggaccctggtggacaggggctggggcaatggctgtggcctgtttggcaagggcagcctcgtgacctgcgccaagttcgcctgcagcaagaagatgaccggcaagagcatccagcccgagaacctggaataccggatcatgctgagcgtgcacggctcccagcacagcggcatgatcgtgaacgacaccggccacgagacagacgagaaccgggccaaggtggaaatcacccccaacagccctagagccgaggccacactgggcggctttggatctctgggcctggactgcgagcctagaaccggcctggatttcagcgacctgtactacctgaccatgaacaacaaacactggctggtgcacaaagagtggttccacgacatccccctgccctggcatgctggcgctgatacaggcaccccccactggaacaacaaagaggccctggtggaattcaaggacgcccacgccaagcggcagaccgtggtggtgctgggatctcaggaaggcgccgtgcatacagctctggctggcgccctggaagccgaaatggatggcgccaaaggcagactgagcagcggccacctgaagtgccggctgaagatggacaagctgcggctgaagggcgtgtcctacagcctgtgtaccgccgccttcaccttcaccaagatccccgccgagacactgcacggcaccgtgactgtggaagtgcagtacgccggcaccgacggcccttgtaaagtgcctgctcagatggccgtggatatgcagaccctgacccccgtgggcaggctgatcacagccaaccctgtgatcaccgagagcaccgagaacagcaagatgatgctggaactggacccccccttcggcgactcctacatcgtgatcggcgtgggagagaagaagatcacccaccactggcacagaagcggcagcaccatcggcaaggcctttgaggctacagtgcggggagccaagagaatggccgtgctgggcgataccgcctgggattttggctctgtgggcggagccctgaacagcctgggaaagggcatccaccagatcttcggagccgcctttaagagcctgttcggcggcatgagctggttcagccagatcctgatcggcaccctgctgatgtggctgggcctgaacaccaagaacggcagcatctccctgatgtgcctggctctgggcggcgtgctgatctttctgagcacagccgtgtccgcc

SEQ ID NO: 135 - DNA, 2064 bp, Artificial Sequence
  Synthetic Polynucleotide
atgaagtgcctgctgtacctggccttcctgttcatcggcgtgaactgcgccgaagtgaccagaagaggcagcgcctactacatgtacctggaccggaacgatgccggcgaggccatcagctttccaaccaccctgggcatgaacaagtgctacatccagatcatggacctgggccacatgtgcgacgccaccatgagctacgagtgccccatgctggacgagggcgtggaacccgacgatgtggactgctggtgcaacaccaccagcacctgggtggtgtacggcacctgtcaccacaagaagggcgaagccagacggtccagacgggccgtgacactgcctagccacagcaccagaaagctgcagacccggtcccagacctggctggaaagcagagagtacaccaagcacctgatccgggtggaaaactggatcttccggaaccccggctttgccctggccgctgctgctattgcttggctgctgggcagcagcacctcccagaaagtgatctacctcgtgatgatcctgctgatcgcccctgcctacagcatccggtgtatcggcgtgtccaaccgggacttcgtggaaggcatgagcggcggcacatgggtggacgtggtgctggaacatggcggctgcgtgacagtgatggcccaggacaagcccaccgtggacatcgagctcgtgaccaccaccgtgtccaatatggccgaagtgcggagctactgctacgaggccagcatcagcgacatggccagcgacagcagatgccctacacagggcgaggcctacctggacaagcagtccgacacccagtacgtgtgcaagcggaccctggtggatagaggctggggcaatggctgcggcctgtttggcaagggcagcctcgtgacctgtgccaagttcgcctgcagcaagaagatgaccggcaagagcatccagcccgagaacctggaataccggatcatgctgagcgtgcacggcagccagcactccggcatgatcgtgaacgacaccggccacgagacagacgagaaccgggccaaggtggaaatcacccccaacagccctagagccgaggccacactgggcggctttggatctctgggcctggactgcgagcctagaaccggcctggatttcagcgacctgtactacctgaccatgaacaacaagcactggctggtgcacaaagagtggttccacgacatccccctgccctggcatgccggcgctgatacaggcacaccccactggaacaacaaagaggctctggtggaattcaaggacgcccacgccaagcggcagaccgtggtggtgctgggatctcaggaaggcgccgtgcatacagctctggctggcgccctggaagccgaaatggatggcgccaaaggcagactgtccagcggccacctgaagtgcagactgaagatggacaagctgcggctgaagggcgtgtcctacagcctgtgtaccgccgccttcaccttcaccaagatccccgccgagacactgcacggcaccgtgactgtggaagtgcagtacgccggcaccgacggcccttgtaaagtgccagctcagatggccgtggatatgcagaccctgacccccgtgggcagactgatcaccgccaaccctgtgatcaccgagagcaccgagaacagcaagatgatgctggaactggacccccccttcggcgactcctacatcgtgatcggcgtgggagagaagaagatcacccaccactggcacagaagcggcagcaccatcggcaaggcctttgaggctacagtgcggggagccaagagaatggccgtgctgggagataccgcctgggactttggctctgtgggcggagccctgaactctctgggcaagggaatccaccagatcttcggagccgcctttaagagcctgttcggcggcatgagctggttcagccagatcctgatcggcaccctgctgatgtggctgggcctgaacaccaagaacggcagcatctccctgatgtgcctggctctgggaggcgtgctgatcttcctgagcacagccgtgtctgcc

SEQ ID NO: 136 - DNA, 2070 bp, Artificial Sequence
  Synthetic Polynucleotide
atggactggacctggatcctgttcctggtggccgctgccacaagagtgcacagcgtggaagtgaccagacggggcagcgcctactacatgtacctggacagaagcgacgccggcgaggccatcagctttccaaccaccctgggcatgaacaagtgctacatccagatcatggacctgggccacatgtgcgacgccaccatgagctacgagtgccccatgctggacgagggcgtggaacccgacgatgtggactgctggtgcaacaccaccagcacctgggtggtgtacggcacctgtcaccacaagaagggcgaagccagacggtccagacgggccgtgacactgcctagccacagcaccagaaagctgcagacccggtcccagacctggctggaaagcagagagtacaccaagcacctgatccgggtggaaaactggatcttccggaaccccggctttgccctggctgccgctgctattgcttggctgctgggcagcagcacctcccagaaagtgatctacctcgtgatgatcctgctgatcgcccctgcctacagcatccggtgtatcggcgtgtccaaccgggacttcgtggaaggcatgagcggcggcacatgggtggacgtggtgctggaacatggcggctgcgtgacagtgatggcccaggataagcccgccgtggacatcgagctcgtgaccaccaccgtgtccaatatggccgaagtgcggagctactgctacgaggccagcatcagcgacatggccagcgacagcagatgccctacacagggcgaggcctacctggataagcagtccgacacccagtacgtgtgcaagcggaccctggtggatagaggctggggcaatggctgcggcctgtttggcaagggcagcctcgtgacctgcgccaagttcgcctgcagcaagaagatgaccggcaagagcatccagcccgagaacctggaataccggatcatgctgagcgtgcacggctcccagcacagcggcatgatcgtggccgacaccggccacgagacagacgagaaccgggccaaggtggaaatcacccccaacagccctagagccgaggccacactgggcggctttggatctctgggcctggactgcgagcctagaaccggcctggatttcagcgacctgtactacctgaccatgaacaacaagcactggctggtgcacaaagagtggttccacgacatccccctgccctggcatgctggcgctgatacaggcaccccccactggaacaacaaagaggctctggtggaattcaaggacgcccacgccaagcggcagaccgtggtggtgctgggatctcaggaaggcgccgtgcatacagctctggctggcgccctggaagccgaaatggatggcgccaaaggcagactgtcctccggccacctgaagtgccggctgaagatggacaagctgcggctgaagggcgtgtcctacagcctgtgtaccgccgccttcaccttcaccaagatccccgccgagacactgcacggcaccgtgactgtggaagtgcagtacgccggcaccgacggcccttgtaaagtgcctgctcagatggccgtggatatgcagaccctgacccccgtgggcagactgatcaccgccaaccctgtgatcaccgagagcaccgagaacagcaagatgatgctggaactggacccccccttcggcgactcctacatcgtgatcggcgtgggagagaagaagatcacccaccactggcacagatccggcagcaccatcggcaaggcctttgaggctacagtgcggggagccaagagaatggccgtgctgggcgataccgcctgggattttggctctgtgggcggagccctgaacagcctgggaaagggcatccaccagatcttcggcgctgccttcaagagcctgttcggcggcatgagctggttcagccagatcctgatcggcaccctgctcgtgtggctgggcctgaacaccaagaacggcagcatctccctgacctgcctggctctgggcggcgtgctgatctttctgagcacagccgtgtccgcc

SEQ ID NO: 137 - RNA, 10254 nt, Zika Virus
augaaaaacccaaagaagaaauccggaggauuccggauugucaauaugcuaaaacgcggaguagcccguguaaaccccuugggagguuugaagaggcugccagccggacuucugcugggucauggacccaucagaaugguuuuggcgauauuagccuuuuugagauucacagcaaucaagccaucacugggccucaucaacagaugggguaccguggggaaaaaagaggcuauggaaauaauaaaaaaauuuaagaaagaucuugcugccauguugagaauaaucaaugcuaggaaggagaggaagagacguggcgcagacaccagcaucggaaucguuggccuccuguugacuacagccauggcagcagagaucacuagacgugggagugcauacuacauguacuuggauaggagcgaugcagggaaggccauuucuuucgcuaccacauugggggugaacaaaugccaugugcagaucauggaccucgggcacaugugugacgccaccaugagcuaugaaugcccuaugcuggacgaggggguggaaccagaugacgucgauugcuggugcaacacgacaucaacuuggguuguguacggaaccugucaucauaaaaaaggugaagcacggcgaucuagaagagccgucacgcucccaucucacuccacaaggaaauugcaaacgcggucgcagacuuggcuagaaucaagagaauacacaaagcaccugaucaagguugaaaauuggauauucaggaacccugguuuuacgcuaguggcugucgccaucgccuggcuuuugggaagcucgacgagccaaaaagucauauacuuggucaugauacugcugauugccccggcauacaguaucaggugcauaggagucagcaauagagacuucguggagggcaugucaggugggaccuggguugacguuguccuggaacauggaggcugcgucaccgugauggcacaggacaagccaacaguugacauagagcuggucacaacaacgguuaguaacauggccgaggugagauccuauuguuacgaggcaucaauaucggacauggcuucggacagucgcugcccaacacaaggugaagccuaccuugacaagcaaucagacacucaauauguuugcaaaagaacauugguggacagagguuggggaaauggguguggacucuuuggcaaagggaguuuggugacaugugcuaaguucacgugcuccaagaagaugacugggaagagcauucagccggagaaccuggaguaucggauaaugcuaucagugcauggcucccagcacagugggaugauuguuaaugaugaaaacagagcgaaggucgagguuacgcccaauucaccaagagcagaagcaacccugggaggcuuuggaagcuuaggacuugauugugaaccaaggacaggccuugacuuuucagaucuguauuaccuaaccaugaauaacaagcauugguuggugcacaaagagugguuucaugacaucccauugcccuggcaugcuggggcagacacuggaacuccacauuggaacaacaaggaggcauuaguggaauucaaggacgcccacgccaagaggcaaaccgucgugguuuuggggagccaggaaggagccguccacacggcucuugcuggagcucuagaggcugagauggauggugcaaagggaaggcuauucucuggccacuugaaaugucgcuuaaaaauggacaagcuuagauugaagggcgugucauauuccuugugcaccgcggcauucacauucaccaaggucccggcugaaacacuacauggaacagucacaguggaggugcaguaugcagggacagauggacccugcaaggucccagcccagauggcgguggacaugcagaccuugaccccagucggaaggcugauaaccgccaaccccgugauuacugaaagcacugagaauucaaagaugauguuggagcucgacccaccauuuggggauucuuacauugucauaggaguuggggauaagaaaaucacccaucacuggcauaggaguggcagcaccauuggaaaagcauuugaagccacugugagaggcgcuaagagaauggcaguccugggggacacagcuugggacuuuggaucagucggagguguguuuaacucauugggcaagggcauucaucagauuuuuggagcagcuuucaaaucacuguuuggaggaauguccugguucucacagauccucauaggcacucugcuggugugguuaggucugaacacaaagaaugggucuaucucccucacaugcuuagcccuggggggagugaugaucuuccucuccacggcuguuucugcugacguggggugcucgguggacuucucaaaaaaagaaacgagauguggcacggggguguucgucuacaaugacguugaagccuggagggaccgguacaaguaccauccugacuccccucguagacuggcagcagccguuaagcaagcuugggaagaggggauuugugggaucuccucuguuucuagaauggaaaacauaauguggaaaucaguggaaggagagcucaaugcaauccuagaggagaauggaguccaacugacaguuguugugggaucuguaaaaaaccccauguggagaggcccacaaagauugccagugccugugaaugagcugccccauggcuggaaagccugggggaaaucguacuuuguuagggcggcaaagaccaacaacaguuuuguugucgacggugacacauugaaggaauguccgcucaagcacagagcauggaacagcuuccucguggaggaucacggguuuggggucuuccacaccaguguuuggcuuaagguuagagaagauuacucacuggagugugacccagccgucauaggaacagcuguuaagggaaaggaggccgcgcacagugaucuaggcuauuggauugaaagugaaaagaaugacacauggaggcugaagagggcucauuugauugagaugaaaacaugugaguggccaaagucucacacacuguggacagauggaguggaagaaagugaucugaucauacccaagucuuuagcugguccacucagccaccacaacaccagagaggguuacagaacucaagugaaagggccauggcauagugaggagcuugaaauccgauuugaggaauguccagguaccaagguucauguggaggagacaugcggaacgagaggaccaucucugagaucaaccacugcaagcggaagggucauugaggaauggugcuguagggaaugcacaaugcccccacuaucguuccgagcaaaagauggcugcugguauggaauggagauaaggccuaggaaagaaccagagagcaacuuagugaggucaauggugacagcgggaucaaccgaucauauggaucauuuuucucuuggagugcuugugauucuacucauggugcaggaaggguugaagaagagaaugaccacaaagaucaucaugagcacaucaauggcagugcugguggccaugaucuugggaggauucucaaugagugaccuggcuaagcuugugauccugaugggggccacuuucgcagaaaugaacacuggaggagacguagcucacuuggcauuaguagcggcauuuaaagucagaccagccuugcuggucucauuuaucuucagagccaacuggacaccucgugagagcaugcugcuagccuuggcuucgugucuucugcaaacugcgaucuccgcucuugaaggcgacuugaugguccucguuaauggauuugcuuuggccugguuggcaauacgugcaauggccgugccacgcacugacaacaucgcucuagcaauucuggcugcucuaacaccacuagcccgaggcacacugcucguggcauggagagcgggccucgccacuuguggaggguucaugcuccucucccugaaagggaaagguagugugaagaagaaccugccauucgucgcggccuugggauugaccgcugugagaauaguggaccccauuaauguggugggacuacuguuacucacaaggagugggaagcggagcuggcccccuagugaagugcucacugcugucggccugauaugugcauuggccggaggguuugccaaggcagacauagagauggcugggcccauggcggcagugggccugcuaauugucaguuauguggucucgggaaagaguguagauauguacauugaaagagcaggugacaucacaugggagaaagacgcggaagucacuggaaacaguccucggcuugacguggcacuagaugagaguggugauuucucucugguggaggaagaugguccacccaugagagagaucauacuuaagguggucuugauggccaucuguggcaugaacccaauagccauaccuuuugcugcaggagcgugguauguguaugugaagacugggaaaaggaguggugcccucugggacgugccugcuccgaaagaagugaaaaaaggagagaccacagauggaguguacagagugaugacucgcagacugcuggguucaacacaaguuggagugggagucaugcaggagggagucuuccacaccauguggcacgucacaaaaggggccgcauugaggagcggugaagggagacuugauccauacuggggggaugucaagcaggacuuggugucauauugugggccuuggaagcuggacgcagcuugggacggaguuagugaggugcagcuucuggccguacccccuggagagagagccagaaacauucagacucugccuggaauauuuaagacaaaggauggggacaucggagcaguugcuuuggacuauccugcaggaaccucaggaucuccgauccuagacaaaugcgggagagugauaggacucuauggcaaugggguugugaucaagaacggaagcuauguuagugcuauaacccagggaaagagggaggaggagacuccgguugaguguuuugaacccucgaugcugaagaagaagcagcuaacuguccuggaccugcauccaggggcugggaaaaccaggagaguucuuccugaaauaguccgugaagcuauaaagaagagacuccgcacggugaucuuggcaccaaccagggucgucgcugcugagauggaggaagcccugagaggacuuccggugcguuacaugacaacagcagucaaggucacccauucugggacagaaaucguugauuugaugugccaugccaccuucacuucacgccuacuacaacccauuagagucccuaauuacaaccucuacaucauggaugaagcccauuucacagaccccucaagcauagcugcaagaggauauauaucaacaaggguugagaugggcgaggcagcagccaucuuuaugacugccacaccaccaggaacccgcgaugcguuuccagauuccaacucaccaaucauggacacagaaguggaagucccagagagagccuggagcucaggcuuugauugggugacggaccauucugggaaaacaguuugguucguuccaagcgugaggaauggaaaugaaaucgcagccugucugacaaaggcuggaaagcggguuauacagcuuaguaggaaaacuuuugagacagaguuucagaaaacaaaaaaucaagagugggacuuugucauaacaacugacaucucagagaugggugccaacuucaaggcugaccggguuauagauuccaggagaugccuaaagccaguuauacuugauggugagagagucaucuuggcugggcccaugccugucacgcaugcuagcgcugcucagaggagaggacguauaggcaggaaccccaacaagccuggagaugaguacauguauggaggugggugugcggagacugaugaagaccaugcacauuggcuugaagcaagaaugcuucuugacaacauuuaccuccaggauggccucauagccucgcucuaucgaccugaggccgacaagguagccgccauugagggagaguuuaagcugaggacagagcaaaggaagaccuuuguggaacucaugaagagaggagaucuucccguuugguuggccuaccagguugcaucugccggaauaacuuauacagacagaagaugguguuuugauggcacaaccaacaacaccauaauggaagacaguguaccagcagagguguggaccaaguauggagagaagagagugcucaaaccaagauggauggacgccagggucugcucagaucaugcggcccugaagucguucaaagaauucgccgcugggaaaagaggagcggcuuugggaguaauggaggcccugggaacauuaccaggacacaugacagagagguuucaggaagccauugauaaccucgcugugcucaugcgagcagagacuggaagcaggcccuacaaggcagcggcagcccaauugccggagacccuagagaccaucaugcuuuuaggccugcugggaacaguaucgcuggggaucuuuuuugucuugaugaggaacaagggcaucgggaagaugggcuuugaaaugguaacccuuggggccagcgcauggcucauguggcucucagaaaucgaaccagccagaauugcauguguccuuauuguuguguuuuuauuacugguggugcuaauaccagagccagagaagcaaagauccccccaggacaaucagauggcaaucauuauuaugguggcagugggccuuuugggguugauaacugcaaaugaacuuggauggcuggagagaacaaaaaaugacauagcucaucugaugggaaagagagaagagggaacaaccgugggauucucaauggacaucgaucugcgaccagccuccgcaugggcuauuuaugccgcauugacaacccucaucaccccagccguccagcacgcgguaacuaccucguacaacaacuacuccuuaauggcgauggccacacaagcuggagugcuguuuggcaugggcaaagggaugccauuuuaugcaugggacuuaggagucccguugcuaaugaugggcugcuacucacaacuaacaccccugacccugauaguagccaucauuuugcuuguggcacauuacauguacuugaucccaggccuacaggcagcagcagcacgcgcugcccagaagagaacagcagccggcaucaugaagaaucccguuguggauggaauagugguaacugacauugacacaaugacaauugacccccaaguggagaagaagaugggacaagugcuacuuauagcaguggcugucuccagugcuguguugcugcggaccgcuuggggauggggggaggcuggagcuuugaucacagcagcaacuuccacccugugggaaggcuccccaaacaaauacuggaacuccuccacagccaccucacugugcaacaucuucagaggaaguuacuuggcaggagcuucccuuauuuacacagugacaagaaaugccggccugguuaagagacguggagguggaacgggagaaacucugggagagaaguggaaagcccgccugaaucagaugucggccuuggaguucuacucuuacaaaaagucaggcaucacugaaguauguagagaggaggcucgccgcgcccucaaggauggaguggccacaggaggacaugcuguaucccgaggaagcgcaaaacucagaugguugguggagagaggauaucugcagcccuauggaaagguuguugaucucggaugcggcagagggggcuggaguuauuaugccgccaccauccgcaaagugcaggaggugagaggauacacaaagggaggucccggucaugaagagcccaugcuggugcaaagcuauggguggaacauaauucgucucaagaguggaguggacgucuuccacauggcggcugagucgugugacacuuugcugugugacauaggugagucaucauccaguccugaaguggaggagacgcgaacacucagagugcucuccauggugggggacuggcuugagaagagaccaggggccuucugcauaaagguguuaugcccauacaccagcaccaugauggagaccauggagcgacugcaacguagguaugggggaggacuagucagagugccacugucccgcaauucuacacaugagauguauugggucucuggagcaaaaaguaacaucauaaaaaguguguccaccacaagucagcuccuccugggacgcauggaugggcccaggaggccagugaaguaugaggaggaugugaaccucggcucaggcacacgagcuguggcaagcugugcugaggcucccaacaugaaggucauugguaggcgcauugagagaauccguagugaacaugcagaaacaugguucuuugaugaaaaccauccauacaggacaugggccuaccacgggagcuacgaagcccccacgcaagggucagcaucuucccucgugaaugggguuguuagacuccugucaaagcccugggauguggugacuggaguuacaggaauagcuaugacugacaccacaccguacggccaacaaagagucuucaaagaaaaaguggacaccagggugccagacccucaagaagguacucgccagguaaugaacauggucgcuuccuggcuguggaaggagcugggaaaacguaagcggccacgugucugcaccaaagaagaguucaucaacaaggugcgcagcaaugcagcacugggagcaauauuugaagaggaaaaagaauggaagacggcuguggaagcugugaaugauccaagguuuugggcccuaguggauaaggaaagagaacaccaccugagaggagagugccauaguuguguguacaacaugaugggaaaaagagaaaagaagcaaggggaauucgggaaagcaaaaggcagucgcgccaucugguacaugugguugggagccagauucuuggaguuugaagcccuuggauucuugaacgaggaccauuggaugggaagagaaaacucaggagguggugucgaaggguugggacugcaaagacuuggauacguucuagaagaaaugagccgggcaccaggaggaaagauguaugcagaugacaccgcuggcugggacacccgcauuagcaaguuugauuuggagaaugaagccuugauuacuaaccaaauggaugaagggcacagaacucuggcguuggccgugauuaaguacacauaccaaaacaaaguggugaagguccucagaccagcugaaggaggaaaaacagucauggacaucauuucaagacaagaccagagggggagcggacaaguugucacuuaugcucucaacacauuuaccaacuugguggugcagcucauccggaacauggaggcugaggaaguguuagagaugcaagacuuauggcuguugaggaagccagagaaaguaaccagauggcugcagaguagcggaugggacagacucaaacgaauggcagucaguggugaugacuguguuguaaagccaauugaugacagguuugcacacgcccucagguucuugaaugauauggggaaaguuaggaaagacacacaggaauggaaacccucaacuggauggagcaacugggaagaagucccguucugcucccaccacuuuaacaagcugcaccucaaagacgggagauccauuguggucccuugccgccaccaagaugaacugauuggccgggcucgcguuucgccgggggcaggauggagcauccgggagacugccugucuugcaaaaucauaugcacagauguggcagcuucuuuauuuccacagaagagaccuccgacugauggccaaugccauuugcucggccgugccaguugacugggucccaacugggagaacuaccuggucaauccauggaaagggagaauggaugacuacugaggacaugcucaugguguggaauagaguguggauugaggagaaugaucacauggaggacaagaccccuguaacaaaauggacagacauucccuauuugggaaaaagggaggacuuaugguguggaucccuuauaggacacagaccucgcaccacuugggcugagaacaucaaagacacagucagcauggugcgcagaaucauaggugaugaagaaaaguacauggacuaccuauccacucaaguucgcuacuugggugaggaagggucuacaccuggagugcuguaa

SEQ ID NO: 138 - RNA, 2281 nt, Zika Virus
ucaagcuuuuggacccucguacagaagcuaauacgacucacuauagggaaauaagagagaaaagaagaguaagaagaaauauaagagccaccauggacuggaccuggauccuguuccugguggccgcugccacaagagugcacagcguggaagugaccagacggggcagcgccuacuacauguaccuggacagaagcgacgccggcgaggccaucagcuuuccaaccacccugggcaugaacaagugcuacauccagaucauggaccugggccacaugugcgacgccaccaugagcuacgagugccccaugcuggacgagggcguggaacccgacgauguggacugcuggugcaacaccaccagcaccugggugguguacggcaccugucaccacaagaagggcgaagccagacgguccagacgggccgugacacugccuagccacagcaccagaaagcugcagacccggucccagaccuggcuggaaagcagagaguacaccaagcaccugauccggguggaaaacuggaucuuccggaaccccggcuuugcccuggcugccgcugcuauugcuuggcugcugggcagcagcaccucccagaaagugaucuaccucgugaugauccugcugaucgccccugccuacagcauccgguguaucggcguguccaaccgggacuucguggaaggcaugagcggcggcacauggguggacguggugcuggaacauggcggcugcgugacagugauggcccaggauaagcccgccguggacaucgagcucgugaccaccaccguguccaauauggccgaagugcggagcuacugcuacgaggccagcaucagcgacauggccagcgacagcagaugcccuacacagggcgaggccuaccuggauaagcaguccgacacccaguacgugugcaagcggacccugguggauagaggcuggggcaauggcugcggccuguuuggcaagggcagccucgugaccugcgccaaguucgccugcagcaagaagaugaccggcaagagcauccagcccgagaaccuggaauaccggaucaugcugagcgugcacggcucccagcacagcggcaugaucgugaacgacaccggccacgagacagacgagaaccgggccaagguggaaaucacccccaacagcccuagagccgaggccacacugggcggcuuuggaucucugggccuggacugcgagccuagaaccggccuggauuucagcgaccuguacuaccugaccaugaacaacaagcacuggcuggugcacaaagagugguuccacgacaucccccugcccuggcaugcuggcgcugauacaggcaccccccacuggaacaacaaagaggcucugguggaauucaaggacgcccacgccaagcggcagaccgugguggugcugggaucucaggaaggcgccgugcauacagcucuggcuggcgcccuggaagccgaaauggauggcgccaaaggcagacuguccuccggccaccugaagugccggcugaagauggacaagcugcggcugaagggcguguccuacagccuguguaccgccgccuucaccuucaccaagauccccgccgagacacugcacggcaccgugacuguggaagugcaguacgccggcaccgacggcccuuguaaagugccugcucagauggccguggauaugcagacccugacccccgugggcagacugaucaccgccaacccugugaucaccgagagcaccgagaacagcaagaugaugcuggaacuggacccccccuucggcgacuccuacaucgugaucggcgugggagagaagaagaucacccaccacuggcacagauccggcagcaccaucggcaaggccuuugaggcuacagugcggggagccaagagaauggccgugcugggcgauaccgccugggauuuuggcucugugggcggagcccugaacagccugggaaagggcauccaccagaucuucggcgcugccuucaagagccuguucggcggcaugagcugguucagccagauccugaucggcacccugcucguguggcugggccugaacaccaagaacggcagcaucucccugaccugccuggcucugggcggcgugcugaucuuucugagcacagccguguccgccugauaauaggcuggagccucgguggccaugcuucuugccccuugggccuccccccagccccuccuccccuuccugcacccguacccccguggucuuugaauaaagucugagugggcggc

SEQ ID NO: 139 - RNA, 2070 nt, Zika Virus
auggacuggaccuggauccuguuccugguggccgcugccacaagagugcacagcguggaagugaccagacggggcagcgccuacuacauguaccuggacagaagcgacgccggcgaggccaucagcuuuccaaccacccugggcaugaacaagugcuacauccagaucauggaccugggccacaugugcgacgccaccaugagcuacgagugccccaugcuggacgagggcguggaacccgacgauguggacugcuggugcaacaccaccagcaccugggugguguacggcaccugucaccacaagaagggcgaagccagacgguccagacgggccgugacacugccuagccacagcaccagaaagcugcagacccggucccagaccuggcuggaaagcagagaguacaccaagcaccugauccggguggaaaacuggaucuuccggaaccccggcuuugcccuggcugccgcugcuauugcuuggcugcugggcagcagcaccucccagaaagugaucuaccucgugaugauccugcugaucgccccugccuacagcauccgguguaucggcguguccaaccgggacuucguggaaggcaugagcggcggcacauggguggacguggugcuggaacauggcggcugcgugacagugauggcccaggauaagcccgccguggacaucgagcucgugaccaccaccguguccaauauggccgaagugcggagcuacugcuacgaggccagcaucagcgacauggccagcgacagcagaugcccuacacagggcgaggccuaccuggauaagcaguccgacacccaguacgugugcaagcggacccugguggauagaggcuggggcaauggcugcggccuguuuggcaagggcagccucgugaccugcgccaaguucgccugcagcaagaagaugaccggcaagagcauccagcccgagaaccuggaauaccggaucaugcugagcgugcacggcucccagcacagcggcaugaucgugaacgacaccggccacgagacagacgagaaccgggccaagguggaaaucacccccaacagcccuagagccgaggccacacugggcggcuuuggaucucugggccuggacugcgagccuagaaccggccuggauuucagcgaccuguacuaccugaccaugaacaacaagcacuggcuggugcacaaagagugguuccacgacaucccccugcccuggcaugcuggcgcugauacaggcaccccccacuggaacaacaaagaggcucugguggaauucaaggacgcccacgccaagcggcagaccgugguggugcugggaucucaggaaggcgccgugcauacagcucuggcuggcgcccuggaagccgaaauggauggcgccaaaggcagacuguccuccggccaccugaagugccggcugaagauggacaagcugcggcugaagggcguguccuacagccuguguaccgccgccuucaccuucaccaagauccccgccgagacacugcacggcaccgugacuguggaagugcaguacgccggcaccgacggcccuuguaaagugccugcucagauggccguggauaugcagacccugacccccgugggcagacugaucaccgccaacccugugaucaccgagagcaccgagaacagcaagaugaugcuggaacuggacccccccuucggcgacuccuacaucgugaucggcgugggagagaagaagaucacccaccacuggcacagauccggcagcaccaucggcaaggccuuugaggcuacagugcggggagccaagagaauggccgugcugggcgauaccgccugggauuuuggcucugugggcggagcccugaacagccugggaaagggcauccaccagaucuucggcgcugccuucaagagccuguucggcggcaugagcugguucagccagauccugaucggcacccugcucguguggcugggccugaacaccaagaacggcagcaucucccugaccugccuggcucugggcggcgugcugaucuuucugagcacagccguguccgcc

SEQ ID NO: 140 - RNA, 2342 nt, Zika Virus
ggggaaauaagagagaaaagaagaguaagaagaaauauaagagccaccauggacuggaccuggauccuguuccugguggccgcugccacaagagugcacagcguggaagugaccagacggggcagcgccuacuacauguaccuggacagaagcgacgccggcgaggccaucagcuuuccaaccacccugggcaugaacaagugcuacauccagaucauggaccugggccacaugugcgacgccaccaugagcuacgagugccccaugcuggacgagggcguggaacccgacgauguggacugcuggugcaacaccaccagcaccugggugguguacggcaccugucaccacaagaagggcgaagccagacgguccagacgggccgugacacugccuagccacagcaccagaaagcugcagacccggucccagaccuggcuggaaagcagagaguacaccaagcaccugauccggguggaaaacuggaucuuccggaaccccggcuuugcccuggcugccgcugcuauugcuuggcugcugggcagcagcaccucccagaaagugaucuaccucgugaugauccugcugaucgccccugccuacagcauccgguguaucggcguguccaaccgggacuucguggaaggcaugagcggcggcacauggguggacguggugcuggaacauggcggcugcgugacagugauggcccaggauaagcccgccguggacaucgagcucgugaccaccaccguguccaauauggccgaagugcggagcuacugcuacgaggccagcaucagcgacauggccagcgacagcagaugcccuacacagggcgaggccuaccuggauaagcaguccgacacccaguacgugugcaagcggacccugguggauagaggcuggggcaauggcugcggccuguuuggcaagggcagccucgugaccugcgccaaguucgccugcagcaagaagaugaccggcaagagcauccagcccgagaaccuggaauaccggaucaugcugagcgugcacggcucccagcacagcggcaugaucgugaacgacaccggccacgagacagacgagaaccgggccaagguggaaaucacccccaacagcccuagagccgaggccacacugggcggcuuuggaucucugggccuggacugcgagccuagaaccggccuggauuucagcgaccuguacuaccugaccaugaacaacaagcacuggcuggugcacaaagagugguuccacgacaucccccugcccuggcaugcuggcgcugauacaggcaccccccacuggaacaacaaagaggcucugguggaauucaaggacgcccacgccaagcggcagaccgugguggugcugggaucucaggaaggcgccgugcauacagcucuggcuggcgcccuggaagccgaaauggauggcgccaaaggcagacuguccuccggccaccugaagugccggcugaagauggacaagcugcggcugaagggcguguccuacagccuguguaccgccgccuucaccuucaccaagauccccgccgagacacugcacggcaccgugacuguggaagugcaguacgccggcaccgacggcccuuguaaagugccugcucagauggccguggauaugcagacccugacccccgugggcagacugaucaccgccaacccugugaucaccgagagcaccgagaacagcaagaugaugcuggaacuggacccccccuucggcgacuccuacaucgugaucggcgugggagagaagaagaucacccaccacuggcacagauccggcagcaccaucggcaaggccuuugaggcuacagugcggggagccaagagaauggccgugcugggcgauaccgccugggauuuuggcucugugggcggagcccugaacagccugggaaagggcauccaccagaucuucggcgcugccuucaagagccuguucggcggcaugagcugguucagccagauccugaucggcacccugcucguguggcugggccugaacaccaagaacggcagcaucucccugaccugccuggcucugggcggcgugcugaucuuucugagcacagccguguccgccugauaauaggcuggagccucgguggccaugcuucuugccccuugggccuccccccagccccuccuccccuuccugcacccguacccccguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 141 - RNA, 2272 nt, Zika Virus
ucaagcuuuuggacccucguacagaagcuaauacgacucacuauagggaaauaagagagaaaagaagaguaagaagaaauauaagagccaccauggacuggaccuggauccuguuccugguggccgcugccacaagagugcacagcaccagaagaggcagcgccuacuacauguaccuggacagaagcgacgccggcgaggccaucagcuuuccaaccacccugggcaugaacaagugcuacauccagaucauggaccugggccacaugugcgacgccaccaugagcuacgagugccccaugcuggacgagggcguggaacccgacgauguggacugcuggugcaacaccaccagcaccugggugguguacggcaccugucaccacaagaagggcgaagccagacgguccagacgggccgugacacugccuagccacuccaccagaaagcugcagacccggucccagaccuggcuggaaagcagagaguacaccaagcaccugauccggguggaaaacuggaucuuccggaaccccggcuuugcccuggcugccgcugcuauugcuuggcugcugggcagcagcaccucccagaaagugaucuaccucgugaugauccugcugaucgccccugccuacagcauccgguguaucggcguguccaaccgggacuucguggaaggcaugagcggcggcacauggguggacguggugcuggaacauggcggcugcgugacagugauggcccaggauaagcccgccguggacaucgagcucgugaccaccaccguguccaauauggccgaagugcggagcuacugcuacgaggccagcaucagcgacauggccagcgacagcagaugcccuacacagggcgaggccuaccuggauaagcaguccgacacccaguacgugugcaagcggacccugguggauagaggcuggggcaauggcugcggccuguuuggcaagggcagccucgugaccugcgccaaguucgccugcagcaagaagaugaccggcaagagcauccagcccgagaaccuggaauaccggaucaugcugagcgugcacggcucccagcacagcggcaugaucgugaacgacaccggccacgagacagacgagaaccgggccaagguggaaaucacccccaacagcccuagagccgaggccacacugggcggcuuuggaucucugggccuggacugcgagccuagaaccggccuggauuucagcgaccuguacuaccugaccaugaacaacaagcacuggcuggugcacaaagagugguuccacgacaucccccugcccuggcaugcuggcgcugauacaggcaccccccacuggaacaacaaagaggcucugguggaauucaaggacgcccacgccaagcggcagaccgugguggugcugggaucucaggaaggcgccgugcauacagcucuggcuggcgcccuggaagccgaaauggauggcgccaaaggcagacuguccuccggccaccugaagugccggcugaagauggacaagcugcggcugaagggcguguccuacagccuguguaccgccgccuucaccuucaccaagauccccgccgagacacugcacggcaccgugacuguggaagugcaguacgccggcaccgacggcccuuguaaagugccugcucagauggccguggauaugcagacccugacccccgugggcagacugaucaccgccaacccugugaucaccgagagcaccgagaacagcaagaugaugcuggaacuggacccccccuucggcgacuccuacaucgugaucggcgugggagagaagaagaucacccaccacuggcacagauccggcagcaccaucggcaaggccuuugaggcuacagugcggggagccaagagaauggccgugcugggcgauaccgccugggauuuuggcucugugggcggagcccugaacagccugggaaagggcauccaccagaucuucggagccgccuuuaagagccuguucggcggcaugagcugguucagccagauccugaucggcacccugcucguguggcugggccugaacaccaagaacggcagcaucucccugaccugccuggcucugggcggcgugcugaucuuucugagcacagccguguccgccugauaauaggcuggagccucgguggccaugcuucuugccccuugggccuccccccagccccuccuccccuuccugcacccguacccccguggucuuugaauaaagucugagugggcggc

SEQ ID NO: 142 - RNA, 2061 nt, Zika Virus
auggacuggaccuggauccuguuccugguggccgcugccacaagagugcacagcaccagaagaggcagcgccuacuacauguaccuggacagaagcgacgccggcgaggccaucagcuuuccaaccacccugggcaugaacaagugcuacauccagaucauggaccugggccacaugugcgacgccaccaugagcuacgagugccccaugcuggacgagggcguggaacccgacgauguggacugcuggugcaacaccaccagcaccugggugguguacggcaccugucaccacaagaagggcgaagccagacgguccagacgggccgugacacugccuagccacuccaccagaaagcugcagacccggucccagaccuggcuggaaagcagagaguacaccaagcaccugauccggguggaaaacuggaucuuccggaaccccggcuuugcccuggcugccgcugcuauugcuuggcugcugggcagcagcaccucccagaaagugaucuaccucgugaugauccugcugaucgccccugccuacagcauccgguguaucggcguguccaaccgggacuucguggaaggcaugagcggcggcacauggguggacguggugcuggaacauggcggcugcgugacagugauggcccaggauaagcccgccguggacaucgagcucgugaccaccaccguguccaauauggccgaagugcggagcuacugcuacgaggccagcaucagcgacauggccagcgacagcagaugcccuacacagggcgaggccuaccuggauaagcaguccgacacccaguacgugugcaagcggacccugguggauagaggcuggggcaauggcugcggccuguuuggcaagggcagccucgugaccugcgccaaguucgccugcagcaagaagaugaccggcaagagcauccagcccgagaaccuggaauaccggaucaugcugagcgugcacggcucccagcacagcggcaugaucgugaacgacaccggccacgagacagacgagaaccgggccaagguggaaaucacccccaacagcccuagagccgaggccacacugggcggcuuuggaucucugggccuggacugcgagccuagaaccggccuggauuucagcgaccuguacuaccugaccaugaacaacaagcacuggcuggugcacaaagagugguuccacgacaucccccugcccuggcaugcuggcgcugauacaggcaccccccacuggaacaacaaagaggcucugguggaauucaaggacgcccacgccaagcggcagaccgugguggugcugggaucucaggaaggcgccgugcauacagcucuggcuggcgcccuggaagccgaaauggauggcgccaaaggcagacuguccuccggccaccugaagugccggcugaagauggacaagcugcggcugaagggcguguccuacagccuguguaccgccgccuucaccuucaccaagauccccgccgagacacugcacggcaccgugacuguggaagugcaguacgccggcaccgacggcccuuguaaagugccugcucagauggccguggauaugcagacccugacccccgugggcagacugaucaccgccaacccugugaucaccgagagcaccgagaacagcaagaugaugcuggaacuggacccccccuucggcgacuccuacaucgugaucggcgugggagagaagaagaucacccaccacuggcacagauccggcagcaccaucggcaaggccuuugaggcuacagugcggggagccaagagaauggccgugcugggcgauaccgccugggauuuuggcucugugggcggagcccugaacagccugggaaagggcauccaccagaucuucggagccgccuuuaagagccuguucggcggcaugagcugguucagccagauccugaucggcacccugcucguguggcugggccugaacaccaagaacggcagcaucucccugaccugccuggcucugggcggcgugcugaucuuucugagcacagccguguccgcc

SEQ ID NO: 143 - RNA, 2333 nt, Zika Virus
ggggaaauaagagagaaaagaagaguaagaagaaauauaagagccaccauggacuggaccuggauccuguuccugguggccgcugccacaagagugcacagcaccagaagaggcagcgccuacuacauguaccuggacagaagcgacgccggcgaggccaucagcuuuccaaccacccugggcaugaacaagugcuacauccagaucauggaccugggccacaugugcgacgccaccaugagcuacgagugccccaugcuggacgagggcguggaacccgacgauguggacugcuggugcaacaccaccagcaccugggugguguacggcaccugucaccacaagaagggcgaagccagacgguccagacgggccgugacacugccuagccacuccaccagaaagcugcagacccggucccagaccuggcuggaaagcagagaguacaccaagcaccugauccggguggaaaacuggaucuuccggaaccccggcuuugcccuggcugccgcugcuauugcuuggcugcugggcagcagcaccucccagaaagugaucuaccucgugaugauccugcugaucgccccugccuacagcauccgguguaucggcguguccaaccgggacuucguggaaggcaugagcggcggcacauggguggacguggugcuggaacauggcggcugcgugacagugauggcccaggauaagcccgccguggacaucgagcucgugaccaccaccguguccaauauggccgaagugcggagcuacugcuacgaggccagcaucagcgacauggccagcgacagcagaugcccuacacagggcgaggccuaccuggauaagcaguccgacacccaguacgugugcaagcggacccugguggauagaggcuggggcaauggcugcggccuguuuggcaagggcagccucgugaccugcgccaaguucgccugcagcaagaagaugaccggcaagagcauccagcccgagaaccuggaauaccggaucaugcugagcgugcacggcucccagcacagcggcaugaucgugaacgacaccggccacgagacagacgagaaccgggccaagguggaaaucacccccaacagcccuagagccgaggccacacugggcggcuuuggaucucugggccuggacugcgagccuagaaccggccuggauuucagcgaccuguacuaccugaccaugaacaacaagcacuggcuggugcacaaagagugguuccacgacaucccccugcccuggcaugcuggcgcugauacaggcaccccccacuggaacaacaaagaggcucugguggaauucaaggacgcccacgccaagcggcagaccgugguggugcugggaucucaggaaggcgccgugcauacagcucuggcuggcgcccuggaagccgaaauggauggcgccaaaggcagacuguccuccggccaccugaagugccggcugaagauggacaagcugcggcugaagggcguguccuacagccuguguaccgccgccuucaccuucaccaagauccccgccgagacacugcacggcaccgugacuguggaagugcaguacgccggcaccgacggcccuuguaaagugccugcucagauggccguggauaugcagacccugacccccgugggcagacugaucaccgccaacccugugaucaccgagagcaccgagaacagcaagaugaugcuggaacuggacccccccuucggcgacuccuacaucgugaucggcgugggagagaagaagaucacccaccacuggcacagauccggcagcaccaucggcaaggccuuugaggcuacagugcggggagccaagagaauggccgugcugggcgauaccgccugggauuuuggcucugugggcggagcccugaacagccugggaaagggcauccaccagaucuucggagccgccuuuaagagccuguucggcggcaugagcugguucagccagauccugaucggcacccugcucguguggcugggccugaacaccaagaacggcagcaucucccugaccugccuggcucugggcggcgugcugaucuuucugagcacagccguguccgccugauaauaggcuggagccucgguggccaugcuucuugccccuugggccuccccccagccccuccuccccuuccugcacccguacccccguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 144 - RNA, 2287 nt, Zika Virus
ucaagcuuuuggacccucguacagaagcuaauacgacucacuauagggaaauaagagagaaaagaagaguaagaagaaauauaagagccaccauggaaaccccugcccagcugcuguuccugcugcugcuguggcugccugauaccaccggcguggaagugaccagaagaggcagcgccuacuacauguaccuggacagaagcgacgccggcgaggccaucagcuuuccaaccacccugggcaugaacaagugcuacauccagaucauggaccugggccacaugugcgacgccaccaugagcuacgagugccccaugcuggacgagggcguggaacccgacgauguggacugcuggugcaacaccaccagcaccugggugguguacggcaccugucaccacaagaagggcgaagccagacgguccagacgggccgugacacugccuagccacuccaccagaaagcugcagacccggucccagaccuggcuggaaagcagagaguacaccaagcaccugauccggguggaaaacuggaucuuccggaaccccggcuuugcccuggccgcugcugcuauugcuuggcugcugggcagcagcaccucccagaaagugaucuaccucgugaugauccugcugaucgccccugccuacagcauccgguguaucggcguguccaaccgggacuucguggaaggcaugagcggcggcacauggguggacguggugcuggaacauggcggcugcgugacagugauggcccaggauaagcccgccguggacaucgagcucgugaccaccaccguguccaauauggccgaagugcggagcuacugcuacgaggccagcaucagcgacauggccagcgacagcagaugcccuacacagggcgaggccuaccuggauaagcaguccgacacccaguacgugugcaagcggacccugguggauagaggcuggggcaauggcugcggccuguuuggcaagggcagccucgugaccugcgccaaguucgccugcagcaagaagaugaccggcaagagcauccagcccgagaaccuggaauaccggaucaugcugagcgugcacggcagccagcacuccggcaugaucgugaacgacaccggccacgagacagacgagaaccgggccaagguggaaaucacccccaacagcccuagagccgaggccacacugggcggcuuuggaucucugggccuggacugcgagccuagaaccggccuggauuucagcgaccuguacuaccugaccaugaacaacaagcacuggcuggugcacaaagagugguuccacgacaucccccugcccuggcaugccggcgcugauacaggcacaccccacuggaacaacaaagaggcucugguggaauucaaggacgcccacgccaagcggcagaccgugguggugcugggaucucaggaaggcgccgugcauacagcucuggcuggcgcccuggaagccgaaauggauggcgccaaaggcagacuguccagcggccaccugaagugccggcugaagauggacaagcugcggcugaagggcguguccuacagccuguguaccgccgccuucaccuucaccaagauccccgccgagacacugcacggcaccgugacuguggaagugcaguacgccggcaccgacggcccuuguaaagugccugcucagauggccguggauaugcagacccugacccccgugggcagacugaucaccgccaacccugugaucaccgagagcaccgagaacagcaagaugaugcuggaacuggacccccccuucggcgacuccuacaucgugaucggcgugggagagaagaagaucacccaccacuggcaccgcagcggcagcacaaucggcaaggccuuugaagccacagugcggggagccaagagaauggccgugcugggagauaccgccugggacuuuggcucugugggcggagcccugaacucucugggcaagggaauccaccagaucuucggagccgccuuuaagagccuguucggcggcaugagcugguucagccagauccugaucggcacccugcucguguggcugggccugaacaccaagaacggcagcaucucccugaccugccuggcucugggaggcgugcugaucuuucugagcaccgccgugucugccugauaauaggcuggagccucgguggccaugcuucuugccccuugggccuccccccagccccuccuccccuuccugcacccguacccccguggucuuugaauaaagucugagugggcggc

SEQ ID NO: 145 - RNA, 2076 nt, Zika Virus
auggaaaccccugcccagcugcuguuccugcugcugcuguggcugccugauaccaccggcguggaagugaccagaagaggcagcgccuacuacauguaccuggacagaagcgacgccggcgaggccaucagcuuuccaaccacccugggcaugaacaagugcuacauccagaucauggaccugggccacaugugcgacgccaccaugagcuacgagugccccaugcuggacgagggcguggaacccgacgauguggacugcuggugcaacaccaccagcaccugggugguguacggcaccugucaccacaagaagggcgaagccagacgguccagacgggccgugacacugccuagccacuccaccagaaagcugcagacccggucccagaccuggcuggaaagcagagaguacaccaagcaccugauccggguggaaaacuggaucuuccggaaccccggcuuugcccuggccgcugcugcuauugcuuggcugcugggcagcagcaccucccagaaagugaucuaccucgugaugauccugcugaucgccccugccuacagcauccgguguaucggcguguccaaccgggacuucguggaaggcaugagcggcggcacauggguggacguggugcuggaacauggcggcugcgugacagugauggcccaggauaagcccgccguggacaucgagcucgugaccaccaccguguccaauauggccgaagugcggagcuacugcuacgaggccagcaucagcgacauggccagcgacagcagaugcccuacacagggcgaggccuaccuggauaagcaguccgacacccaguacgugugcaagcggacccugguggauagaggcuggggcaauggcugcggccuguuuggcaagggcagccucgugaccugcgccaaguucgccugcagcaagaagaugaccggcaagagcauccagcccgagaaccuggaauaccggaucaugcugagcgugcacggcagccagcacuccggcaugaucgugaacgacaccggccacgagacagacgagaaccgggccaagguggaaaucacccccaacagcccuagagccgaggccacacugggcggcuuuggaucucugggccuggacugcgagccuagaaccggccuggauuucagcgaccuguacuaccugaccaugaacaacaagcacuggcuggugcacaaagagugguuccacgacaucccccugcccuggcaugccggcgcugauacaggcacaccccacuggaacaacaaagaggcucugguggaauucaaggacgcccacgccaagcggcagaccgugguggugcugggaucucaggaaggcgccgugcauacagcucuggcuggcgcccuggaagccgaaauggauggcgccaaaggcagacuguccagcggccaccugaagugccggcugaagauggacaagcugcggcugaagggcguguccuacagccuguguaccgccgccuucaccuucaccaagauccccgccgagacacugcacggcaccgugacuguggaagugcaguacgccggcaccgacggcccuuguaaagugccugcucagauggccguggauaugcagacccugacccccgugggcagacugaucaccgccaacccugugaucaccgagagcaccgagaacagcaagaugaugcuggaacuggacccccccuucggcgacuccuacaucgugaucggcgugggagagaagaagaucacccaccacuggcaccgcagcggcagcacaaucggcaaggccuuugaagccacagugcggggagccaagagaauggccgugcugggagauaccgccugggacuuuggcucugugggcggagcccugaacucucugggcaagggaauccaccagaucuucggagccgccuuuaagagccuguucggcggcaugagcugguucagccagauccugaucggcacccugcucguguggcugggccugaacaccaagaacggcagcaucucccugaccugccuggcucugggaggcgugcugaucuuucugagcaccgccgugucugcc

SEQ ID NO: 146 - RNA, 2348 nt, Zika Virus
ggggaaauaagagagaaaagaagaguaagaagaaauauaagagccaccauggaaaccccugcccagcugcuguuccugcugcugcuguggcugccugauaccaccggcguggaagugaccagaagaggcagcgccuacuacauguaccuggacagaagcgacgccggcgaggccaucagcuuuccaaccacccugggcaugaacaagugcuacauccagaucauggaccugggccacaugugcgacgccaccaugagcuacgagugccccaugcuggacgagggcguggaacccgacgauguggacugcuggugcaacaccaccagcaccugggugguguacggcaccugucaccacaagaagggcgaagccagacgguccagacgggccgugacacugccuagccacuccaccagaaagcugcagacccggucccagaccuggcuggaaagcagagaguacaccaagcaccugauccggguggaaaacuggaucuuccggaaccccggcuuugcccuggccgcugcugcuauugcuuggcugcugggcagcagcaccucccagaaagugaucuaccucgugaugauccugcugaucgccccugccuacagcauccgguguaucggcguguccaaccgggacuucguggaaggcaugagcggcggcacauggguggacguggugcuggaacauggcggcugcgugacagugauggcccaggauaagcccgccguggacaucgagcucgugaccaccaccguguccaauauggccgaagugcggagcuacugcuacgaggccagcaucagcgacauggccagcgacagcagaugcccuacacagggcgaggccuaccuggauaagcaguccgacacccaguacgugugcaagcggacccugguggauagaggcuggggcaauggcugcggccuguuuggcaagggcagccucgugaccugcgccaaguucgccugcagcaagaagaugaccggcaagagcauccagcccgagaaccuggaauaccggaucaugcugagcgugcacggcagccagcacuccggcaugaucgugaacgacaccggccacgagacagacgagaaccgggccaagguggaaaucacccccaacagcccuagagccgaggccacacugggcggcuuuggaucucugggccuggacugcgagccuagaaccggccuggauuucagcgaccuguacuaccugaccaugaacaacaagcacuggcuggugcacaaagagugguuccacgacaucccccugcccuggcaugccggcgcugauacaggcacaccccacuggaacaacaaagaggcucugguggaauucaaggacgcccacgccaagcggcagaccgugguggugcugggaucucaggaaggcgccgugcauacagcucuggcuggcgcccuggaagccgaaauggauggcgccaaaggcagacuguccagcggccaccugaagugccggcugaagauggacaagcugcggcugaagggcguguccuacagccuguguaccgccgccuucaccuucaccaagauccccgccgagacacugcacggcaccgugacuguggaagugcaguacgccggcaccgacggcccuuguaaagugccugcucagauggccguggauaugcagacccugacccccgugggcagacugaucaccgccaacccugugaucaccgagagcaccgagaacagcaagaugaugcuggaacuggacccccccuucggcgacuccuacaucgugaucggcgugggagagaagaagaucacccaccacuggcaccgcagcggcagcacaaucggcaaggccuuugaagccacagugcggggagccaagagaauggccgugcugggagauaccgccugggacuuuggcucugugggcggagcccugaacucucugggcaagggaauccaccagaucuucggagccgccuuuaagagccuguucggcggcaugagcugguucagccagauccugaucggcacccugcucguguggcugggccugaacaccaagaacggcagcaucucccugaccugccuggcucugggaggcgugcugaucuuucugagcaccgccgugucugccugauaauaggcuggagccucgguggccaugcuucuugccccuugggccuccccccagccccuccuccccuuccugcacccguacccccguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 147 - RNA, 2278 nt, Zika Virus
ucaagcuuuuggacccucguacagaagcuaauacgacucacuauagggaaauaagagagaaaagaagaguaagaagaaauauaagagccaccauggaaaccccugcccagcugcuguuccugcugcugcuguggcugccugauaccaccggcaccagaagaggcagcgccuacuacauguaccuggacagaagcgacgccggcgaggccaucagcuuuccaaccacccugggcaugaacaagugcuacauccagaucauggaccugggccacaugugcgacgccaccaugagcuacgagugccccaugcuggacgagggcguggaacccgacgauguggacugcuggugcaacaccaccagcaccugggugguguacggcaccugucaccacaagaagggcgaagccagacgguccagacgggccgugacacugccuagccacuccaccagaaagcugcagacccggucccagaccuggcuggaaagcagagaguacaccaagcaccugauccggguggaaaacuggaucuuccggaaccccggcuuugcccuggccgcugcugcuauugcuuggcugcugggcagcagcaccucccagaaagugaucuaccucgugaugauccugcugaucgccccugccuacagcauccgguguaucggcguguccaaccgggacuucguggaaggcaugagcggcggcacauggguggacguggugcuggaacauggcggcugcgugacagugauggcccaggauaagcccgccguggacaucgagcucgugaccaccaccguguccaauauggccgaagugcggagcuacugcuacgaggccagcaucagcgacauggccagcgacagcagaugcccuacacagggcgaggccuaccuggauaagcaguccgacacccaguacgugugcaagcggacccugguggauagaggcuggggcaauggcugcggccuguuuggcaagggcagccucgugaccugcgccaaguucgccugcagcaagaagaugaccggcaagagcauccagcccgagaaccuggaauaccggaucaugcugagcgugcacggcagccagcacuccggcaugaucgugaacgacaccggccacgagacagacgagaaccgggccaagguggaaaucacccccaacagcccuagagccgaggccacacugggcggcuuuggaucucugggccuggacugcgagccuagaaccggccuggauuucagcgaccuguacuaccugaccaugaacaacaagcacuggcuggugcacaaagagugguuccacgacaucccccugcccuggcaugccggcgcugauacaggcacaccccacuggaacaacaaagaggcucugguggaauucaaggacgcccacgccaagcggcagaccgugguggugcugggaucucaggaaggcgccgugcauacagcucuggcuggcgcccuggaagccgaaauggauggcgccaaaggcagacuguccagcggccaccugaagugccggcugaagauggacaagcugcggcugaagggcguguccuacagccuguguaccgccgccuucaccuucaccaagauccccgccgagacacugcacggcaccgugacuguggaagugcaguacgccggcaccgacggcccuuguaaagugccugcucagauggccguggauaugcagacccugacccccgugggcagacugaucaccgccaacccugugaucaccgagagcaccgagaacagcaagaugaugcuggaacuggacccccccuucggcgacuccuacaucgugaucggcgugggagagaagaagaucacccaccacuggcaccgcagcggcagcacaaucggcaaggccuuugaagccacagugcggggagccaagagaauggccgugcugggagauaccgccugggacuuuggcucugugggcggagcccugaacucucugggcaagggaauccaccagaucuucggagccgccuuuaagagccuguucggcggcaugagcugguucagccagauccugaucggcacccugcucguguggcugggccugaacaccaagaacggcagcaucucccugaccugccuggcucugggaggcgugcugaucuuucugagcaccgccgugucugccugauaauaggcuggagccucgguggccaugcuucuugccccuugggccuccccccagccccuccuccccuuccugcacccguacccccguggucuuugaauaaagucugagugggcggc

SEQ ID NO: 148 - RNA, 2067 nt, Zika Virus
auggaaaccccugcccagcugcuguuccugcugcugcuguggcugccugauaccaccggcaccagaagaggcagcgccuacuacauguaccuggacagaagcgacgccggcgaggccaucagcuuuccaaccacccugggcaugaacaagugcuacauccagaucauggaccugggccacaugugcgacgccaccaugagcuacgagugccccaugcuggacgagggcguggaacccgacgauguggacugcuggugcaacaccaccagcaccugggugguguacggcaccugucaccacaagaagggcgaagccagacgguccagacgggccgugacacugccuagccacuccaccagaaagcugcagacccggucccagaccuggcuggaaagcagagaguacaccaagcaccugauccggguggaaaacuggaucuuccggaaccccggcuuugcccuggccgcugcugcuauugcuuggcugcugggcagcagcaccucccagaaagugaucuaccucgugaugauccugcugaucgccccugccuacagcauccgguguaucggcguguccaaccgggacuucguggaaggcaugagcggcggcacauggguggacguggugcuggaacauggcggcugcgugacagugauggcccaggauaagcccgccguggacaucgagcucgugaccaccaccguguccaauauggccgaagugcggagcuacugcuacgaggccagcaucagcgacauggccagcgacagcagaugcccuacacagggcgaggccuaccuggauaagcaguccgacacccaguacgugugcaagcggacccugguggauagaggcuggggcaauggcugcggccuguuuggcaagggcagccucgugaccugcgccaaguucgccugcagcaagaagaugaccggcaagagcauccagcccgagaaccuggaauaccggaucaugcugagcgugcacggcagccagcacuccggcaugaucgugaacgacaccggccacgagacagacgagaaccgggccaagguggaaaucacccccaacagcccuagagccgaggccacacugggcggcuuuggaucucugggccuggacugcgagccuagaaccggccuggauuucagcgaccuguacuaccugaccaugaacaacaagcacuggcuggugcacaaagagugguuccacgacaucccccugcccuggcaugccggcgcugauacaggcacaccccacuggaacaacaaagaggcucugguggaauucaaggacgcccacgccaagcggcagaccgugguggugcugggaucucaggaaggcgccgugcauacagcucuggcuggcgcccuggaagccgaaauggauggcgccaaaggcagacuguccagcggccaccugaagugccggcugaagauggacaagcugcggcugaagggcguguccuacagccuguguaccgccgccuucaccuucaccaagauccccgccgagacacugcacggcaccgugacuguggaagugcaguacgccggcaccgacggcccuuguaaagugccugcucagauggccguggauaugcagacccugacccccgugggcagacugaucaccgccaacccugugaucaccgagagcaccgagaacagcaagaugaugcuggaacuggacccccccuucggcgacuccuacaucgugaucggcgugggagagaagaagaucacccaccacuggcaccgcagcggcagcacaaucggcaaggccuuugaagccacagugcggggagccaagagaauggccgugcugggagauaccgccugggacuuuggcucugugggcggagcccugaacucucugggcaagggaauccaccagaucuucggagccgccuuuaagagccuguucggcggcaugagcugguucagccagauccugaucggcacccugcucguguggcugggccugaacaccaagaacggcagcaucucccugaccugccuggcucugggaggcgugcugaucuuucugagcaccgccgugucugcc

SEQ ID NO: 149 - RNA, 2339 nt, Zika Virus
ggggaaauaagagagaaaagaagaguaagaagaaauauaagagccaccauggaaaccccugcccagcugcuguuccugcugcugcuguggcugccugauaccaccggcaccagaagaggcagcgccuacuacauguaccuggacagaagcgacgccggcgaggccaucagcuuuccaaccacccugggcaugaacaagugcuacauccagaucauggaccugggccacaugugcgacgccaccaugagcuacgagugccccaugcuggacgagggcguggaacccgacgauguggacugcuggugcaacaccaccagcaccugggugguguacggcaccugucaccacaagaagggcgaagccagacgguccagacgggccgugacacugccuagccacuccaccagaaagcugcagacccggucccagaccuggcuggaaagcagagaguacaccaagcaccugauccggguggaaaacuggaucuuccggaaccccggcuuugcccuggccgcugcugcuauugcuuggcugcugggcagcagcaccucccagaaagugaucuaccucgugaugauccugcugaucgccccugccuacagcauccgguguaucggcguguccaaccgggacuucguggaaggcaugagcggcggcacauggguggacguggugcuggaacauggcggcugcgugacagugauggcccaggauaagcccgccguggacaucgagcucgugaccaccaccguguccaauauggccgaagugcggagcuacugcuacgaggccagcaucagcgacauggccagcgacagcagaugcccuacacagggcgaggccuaccuggauaagcaguccgacacccaguacgugugcaagcggacccugguggauagaggcuggggcaauggcugcggccuguuuggcaagggcagccucgugaccugcgccaaguucgccugcagcaagaagaugaccggcaagagcauccagcccgagaaccuggaauaccggaucaugcugagcgugcacggcagccagcacuccggcaugaucgugaacgacaccggccacgagacagacgagaaccgggccaagguggaaaucacccccaacagcccuagagccgaggccacacugggcggcuuuggaucucugggccuggacugcgagccuagaaccggccuggauuucagcgaccuguacuaccugaccaugaacaacaagcacuggcuggugcacaaagagugguuccacgacaucccccugcccuggcaugccggcgcugauacaggcacaccccacuggaacaacaaagaggcucugguggaauucaaggacgcccacgccaagcggcagaccgugguggugcugggaucucaggaaggcgccgugcauacagcucuggcuggcgcccuggaagccgaaauggauggcgccaaaggcagacuguccagcggccaccugaagugccggcugaagauggacaagcugcggcugaagggcguguccuacagccuguguaccgccgccuucaccuucaccaagauccccgccgagacacugcacggcaccgugacuguggaagugcaguacgccggcaccgacggcccuuguaaagugccugcucagauggccguggauaugcagacccugacccccgugggcagacugaucaccgccaacccugugaucaccgagagcaccgagaacagcaagaugaugcuggaacuggacccccccuucggcgacuccuacaucgugaucggcgugggagagaagaagaucacccaccacuggcaccgcagcggcagcacaaucggcaaggccuuugaagccacagugcggggagccaagagaauggccgugcugggagauaccgccugggacuuuggcucugugggcggagcccugaacucucugggcaagggaauccaccagaucuucggagccgccuuuaagagccuguucggcggcaugagcugguucagccagauccugaucggcacccugcucguguggcugggccugaacaccaagaacggcagcaucucccugaccugccuggcucugggaggcgugcugaucuuucugagcaccgccgugucugccugauaauaggcuggagccucgguggccaugcuucuugccccuugggccuccccccagccccuccuccccuuccugcacccguacccccguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 150 - RNA, 1783 nt, Zika Virus
ucaagcuuuuggacccucguacagaagcuaauacgacucacuauagggaaauaagagagaaaagaagaguaagaagaaauauaagagccaccauggaaaccccugcccagcugcuguuccugcugcugcuguggcugccugacaccaccggcaucagaugcaucggcguguccaaccgggacuucguggaaggcaugagcggcggcacauggguggacguggugcuggaacauggcggcugcgugacagugauggcccaggauaagcccgccguggacaucgagcucgugaccaccaccguguccaauauggccgaagugcggagcuacugcuacgaggccagcaucagcgacauggccagcgacagcagaugcccuacacagggcgaggccuaccuggacaagcagagcgacacccaguacgugugcaagcggacccugguggauagaggcuggggcaauggcugcggccuguuuggcaagggcagccucgugaccugcgccaaguucgccugcagcaagaagaugaccggcaagagcauccagcccgagaaccuggaauaccggaucaugcugagcgugcacggcagccagcacuccggcaugaucgugaacgacaccggccacgagacagacgagaaccgggccaagguggaaaucacccccaacagcccuagagccgaggccacacugggcggcuuuggaucucugggccuggacugcgagccuagaaccggccuggauuucagcgaccuguacuaccugaccaugaacaacaagcacuggcuggugcacaaagagugguuccacgacaucccccugcccuggcaugccggcgcugauacaggcacaccccacuggaacaacaaagaggcucugguggaauucaaggacgcccacgccaagcggcagaccgugguggugcugggaucucaggaaggcgccgugcauacagcucuggcuggcgcccuggaagccgaaauggauggcgccaaaggcagacugagcagcggccaccugaagugccggcugaagauggacaagcugcggcugaagggcguguccuacagccuguguaccgccgccuucaccuucaccaagauccccgccgagacacugcacggcaccgugacuguggaagugcaguacgccggcaccgacggcccuuguaaagugccugcucagauggccguggauaugcagacccugacccccgugggcaggcugaucacagccaacccugugaucaccgagagcaccgagaacagcaagaugaugcuggaacuggacccccccuucggcgacuccuacaucgugaucggcgugggagagaagaagaucacccaccacuggcacagaagcggcagcaccaucggcaaggccuuugaggcuacagugcggggagccaagagaauggccgugcugggagauaccgccugggacuuuggcucugugggcggagcccugaacucucugggcaagggaauccaccagaucuucggcgcugccuucaagagccuguucggcggcaugagcugguucagccagauccugaucggcacccugcucguguggcugggccugaacaccaagaacggcagcaucucccugaccugccuggcucugggaggcgugcugaucuuucugagcaccgccgugucugccugauaauaggcuggagccucgguggccaugcuucuugccccuugggccuccccccagccccuccuccccuuccugcacccguacccccguggucuuugaauaaagucugagugggcggc

SEQ ID NO: 151 - RNA, 1572 nt, Zika Virus
auggaaaccccugcccagcugcuguuccugcugcugcuguggcugccugacaccaccggcaucagaugcaucggcguguccaaccgggacuucguggaaggcaugagcggcggcacauggguggacguggugcuggaacauggcggcugcgugacagugauggcccaggauaagcccgccguggacaucgagcucgugaccaccaccguguccaauauggccgaagugcggagcuacugcuacgaggccagcaucagcgacauggccagcgacagcagaugcccuacacagggcgaggccuaccuggacaagcagagcgacacccaguacgugugcaagcggacccugguggauagaggcuggggcaauggcugcggccuguuuggcaagggcagccucgugaccugcgccaaguucgccugcagcaagaagaugaccggcaagagcauccagcccgagaaccuggaauaccggaucaugcugagcgugcacggcagccagcacuccggcaugaucgugaacgacaccggccacgagacagacgagaaccgggccaagguggaaaucacccccaacagcccuagagccgaggccacacugggcggcuuuggaucucugggccuggacugcgagccuagaaccggccuggauuucagcgaccuguacuaccugaccaugaacaacaagcacuggcuggugcacaaagagugguuccacgacaucccccugcccuggcaugccggcgcugauacaggcacaccccacuggaacaacaaagaggcucugguggaauucaaggacgcccacgccaagcggcagaccgugguggugcugggaucucaggaaggcgccgugcauacagcucuggcuggcgcccuggaagccgaaauggauggcgccaaaggcagacugagcagcggccaccugaagugccggcugaagauggacaagcugcggcugaagggcguguccuacagccuguguaccgccgccuucaccuucaccaagauccccgccgagacacugcacggcaccgugacuguggaagugcaguacgccggcaccgacggcccuuguaaagugccugcucagauggccguggauaugcagacccugacccccgugggcaggcugaucacagccaacccugugaucaccgagagcaccgagaacagcaagaugaugcuggaacuggacccccccuucggcgacuccuacaucgugaucggcgugggagagaagaagaucacccaccacuggcacagaagcggcagcaccaucggcaaggccuuugaggcuacagugcggggagccaagagaauggccgugcugggagauaccgccugggacuuuggcucugugggcggagcccugaacucucugggcaagggaauccaccagaucuucggcgcugccuucaagagccuguucggcggcaugagcugguucagccagauccugaucggcacccugcucguguggcugggccugaacaccaagaacggcagcaucucccugaccugccuggcucugggaggcgugcugaucuuucugagcaccgccgugucugcc

SEQ ID NO: 152 - RNA, 1844 nt, Zika Virus
ggggaaauaagagagaaaagaagaguaagaagaaauauaagagccaccauggaaaccccugcccagcugcuguuccugcugcugcuguggcugccugacaccaccggcaucagaugcaucggcguguccaaccgggacuucguggaaggcaugagcggcggcacauggguggacguggugcuggaacauggcggcugcgugacagugauggcccaggauaagcccgccguggacaucgagcucgugaccaccaccguguccaauauggccgaagugcggagcuacugcuacgaggccagcaucagcgacauggccagcgacagcagaugcccuacacagggcgaggccuaccuggacaagcagagcgacacccaguacgugugcaagcggacccugguggauagaggcuggggcaauggcugcggccuguuuggcaagggcagccucgugaccugcgccaaguucgccugcagcaagaagaugaccggcaagagcauccagcccgagaaccuggaauaccggaucaugcugagcgugcacggcagccagcacuccggcaugaucgugaacgacaccggccacgagacagacgagaaccgggccaagguggaaaucacccccaacagcccuagagccgaggccacacugggcggcuuuggaucucugggccuggacugcgagccuagaaccggccuggauuucagcgaccuguacuaccugaccaugaacaacaagcacuggcuggugcacaaagagugguuccacgacaucccccugcccuggcaugccggcgcugauacaggcacaccccacuggaacaacaaagaggcucugguggaauucaaggacgcccacgccaagcggcagaccgugguggugcugggaucucaggaaggcgccgugcauacagcucuggcuggcgcccuggaagccgaaauggauggcgccaaaggcagacugagcagcggccaccugaagugccggcugaagauggacaagcugcggcugaagggcguguccuacagccuguguaccgccgccuucaccuucaccaagauccccgccgagacacugcacggcaccgugacuguggaagugcaguacgccggcaccgacggcccuuguaaagugccugcucagauggccguggauaugcagacccugacccccgugggcaggcugaucacagccaacccugugaucaccgagagcaccgagaacagcaagaugaugcuggaacuggacccccccuucggcgacuccuacaucgugaucggcgugggagagaagaagaucacccaccacuggcacagaagcggcagcaccaucggcaaggccuuugaggcuacagugcggggagccaagagaauggccgugcugggagauaccgccugggacuuuggcucugugggcggagcccugaacucucugggcaagggaauccaccagaucuucggcgcugccuucaagagccuguucggcggcaugagcugguucagccagauccugaucggcacccugcucguguggcugggccugaacaccaagaacggcagcaucucccugaccugccuggcucugggaggcgugcugaucuuucugagcaccgccgugucugccugauaauaggcuggagccucgguggccaugcuucuugccccuugggccuccccccagccccuccuccccuuccugcacccguacccccguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 153 - RNA, 2088 nt, Artificial Sequence
  Synthetic Polynucleotide
augcugggcagcaacagcggccagagagugguguucaccauccugcugcugcugguggccccugccuacagcgccgaagugacaagaagaggcagcgccuacuacauguaccuggaccggaacgaugccggcgaggccaucagcuuuccaaccacccugggcaugaacaagugcuacauccagaucauggaccugggccacaugugcgacgccaccaugagcuacgagugccccaugcuggacgagggcguggaacccgacgauguggacugcuggugcaauaccaccagcaccugggugguguacggcaccugucaccacaagaagggcgaagccagacgguccagacgggccgugacacugccuagccacagcaccagaaagcugcagacccggucccagaccuggcuggaaagcagagaguacaccaagcaccugauccggguggaaaacuggaucuuccggaaccccggcuuugcccuggcugccgcugcuauugcuuggcugcugggcucuagcaccagccagaaagugaucuaccucgugaugauccugcugaucgccccagccuacuccauccgguguaucggcguguccaaccgggacuucguggaaggcaugagcggcggcacauggguggacguggugcuggaacauggcggcugcgugacagugauggcccaggacaagcccaccguggacaucgagcucgugaccaccaccguguccaauauggccgaagugcggagcuacugcuacgaggccagcaucagcgacauggccagcgacagcagaugcccuacacagggcgaggccuaccuggacaagcaguccgacacccaguacgugugcaagcggacccugguggacaggggcuggggcaauggcuguggccuguuuggcaagggcagccucgugaccugcgccaaguucgccugcagcaagaagaugaccggcaagagcauccagcccgagaaccuggaauaccggaucaugcugagcgugcacggcucccagcacagcggcaugaucgugaacgacaccggccacgagacagacgagaaccgggccaagguggaaaucacccccaacagcccuagagccgaggccacacugggcggcuuuggaucucugggccuggacugcgagccuagaaccggccuggauuucagcgaccuguacuaccugaccaugaacaacaaacacuggcuggugcacaaagagugguuccacgacaucccccugcccuggcaugcuggcgcugauacaggcaccccccacuggaacaacaaagaggcccugguggaauucaaggacgcccacgccaagcggcagaccgugguggugcugggaucucaggaaggcgccgugcauacagcucuggcuggcgcccuggaagccgaaauggauggcgccaaaggcagacugagcagcggccaccugaagugccggcugaagauggacaagcugcggcugaagggcguguccuacagccuguguaccgccgccuucaccuucaccaagauccccgccgagacacugcacggcaccgugacuguggaagugcaguacgccggcaccgacggcccuuguaaagugccugcucagauggccguggauaugcagacccugacccccgugggcaggcugaucacagccaacccugugaucaccgagagcaccgagaacagcaagaugaugcuggaacuggacccccccuucggcgacuccuacaucgugaucggcgugggagagaagaagaucacccaccacuggcacagaagcggcagcaccaucggcaaggccuuugaggcuacagugcggggagccaagagaauggccgugcugggcgauaccgccugggauuuuggcucugugggcggagcccugaacagccugggaaagggcauccaccagaucuucggagccgccuuuaagagccuguucggcggcaugagcugguucagccagauccugaucggcacccugcugauguggcugggccugaacaccaagaacggcagcaucucccugaugugccuggcucugggcggcgugcugaucuuucugagcacagccguguccgcc

SEQ ID NO: 154 - RNA, 2064 nt, Artificial Sequence
  Synthetic Polynucleotide
augaagugccugcuguaccuggccuuccuguucaucggcgugaacugcgccgaagugaccagaagaggcagcgccuacuacauguaccuggaccggaacgaugccggcgaggccaucagcuuuccaaccacccugggcaugaacaagugcuacauccagaucauggaccugggccacaugugcgacgccaccaugagcuacgagugccccaugcuggacgagggcguggaacccgacgauguggacugcuggugcaacaccaccagcaccugggugguguacggcaccugucaccacaagaagggcgaagccagacgguccagacgggccgugacacugccuagccacagcaccagaaagcugcagacccggucccagaccuggcuggaaagcagagaguacaccaagcaccugauccggguggaaaacuggaucuuccggaaccccggcuuugcccuggccgcugcugcuauugcuuggcugcugggcagcagcaccucccagaaagugaucuaccucgugaugauccugcugaucgccccugccuacagcauccgguguaucggcguguccaaccgggacuucguggaaggcaugagcggcggcacauggguggacguggugcuggaacauggcggcugcgugacagugauggcccaggacaagcccaccguggacaucgagcucgugaccaccaccguguccaauauggccgaagugcggagcuacugcuacgaggccagcaucagcgacauggccagcgacagcagaugcccuacacagggcgaggccuaccuggacaagcaguccgacacccaguacgugugcaagcggacccugguggauagaggcuggggcaauggcugcggccuguuuggcaagggcagccucgugaccugugccaaguucgccugcagcaagaagaugaccggcaagagcauccagcccgagaaccuggaauaccggaucaugcugagcgugcacggcagccagcacuccggcaugaucgugaacgacaccggccacgagacagacgagaaccgggccaagguggaaaucacccccaacagcccuagagccgaggccacacugggcggcuuuggaucucugggccuggacugcgagccuagaaccggccuggauuucagcgaccuguacuaccugaccaugaacaacaagcacuggcuggugcacaaagagugguuccacgacaucccccugcccuggcaugccggcgcugauacaggcacaccccacuggaacaacaaagaggcucugguggaauucaaggacgcccacgccaagcggcagaccgugguggugcugggaucucaggaaggcgccgugcauacagcucuggcuggcgcccuggaagccgaaauggauggcgccaaaggcagacuguccagcggccaccugaagugcagacugaagauggacaagcugcggcugaagggcguguccuacagccuguguaccgccgccuucaccuucaccaagauccccgccgagacacugcacggcaccgugacuguggaagugcaguacgccggcaccgacggcccuuguaaagugccagcucagauggccguggauaugcagacccugacccccgugggcagacugaucaccgccaacccugugaucaccgagagcaccgagaacagcaagaugaugcuggaacuggacccccccuucggcgacuccuacaucgugaucggcgugggagagaagaagaucacccaccacuggcacagaagcggcagcaccaucggcaaggccuuugaggcuacagugcggggagccaagagaauggccgugcugggagauaccgccugggacuuuggcucugugggcggagcccugaacucucugggcaagggaauccaccagaucuucggagccgccuuuaagagccuguucggcggcaugagcugguucagccagauccugaucggcacccugcugauguggcugggccugaacaccaagaacggcagcaucucccugaugugccuggcucugggaggcgugcugaucuuccugagcacagccgugucugcc

SEQ ID NO: 155 - RNA, 2070 nt, Artificial Sequence
  Synthetic Polynucleotide
auggacuggaccuggauccuguuccugguggccgcugccacaagagugcacagcguggaagugaccagacggggcagcgccuacuacauguaccuggacagaagcgacgccggcgaggccaucagcuuuccaaccacccugggcaugaacaagugcuacauccagaucauggaccugggccacaugugcgacgccaccaugagcuacgagugccccaugcuggacgagggcguggaacccgacgauguggacugcuggugcaacaccaccagcaccugggugguguacggcaccugucaccacaagaagggcgaagccagacgguccagacgggccgugacacugccuagccacagcaccagaaagcugcagacccggucccagaccuggcuggaaagcagagaguacaccaagcaccugauccggguggaaaacuggaucuuccggaaccccggcuuugcccuggcugccgcugcuauugcuuggcugcugggcagcagcaccucccagaaagugaucuaccucgugaugauccugcugaucgccccugccuacagcauccgguguaucggcguguccaaccgggacuucguggaaggcaugagcggcggcacauggguggacguggugcuggaacauggcggcugcgugacagugauggcccaggauaagcccgccguggacaucgagcucgugaccaccaccguguccaauauggccgaagugcggagcuacugcuacgaggccagcaucagcgacauggccagcgacagcagaugcccuacacagggcgaggccuaccuggauaagcaguccgacacccaguacgugugcaagcggacccugguggauagaggcuggggcaauggcugcggccuguuuggcaagggcagccucgugaccugcgccaaguucgccugcagcaagaagaugaccggcaagagcauccagcccgagaaccuggaauaccggaucaugcugagcgugcacggcucccagcacagcggcaugaucguggccgacaccggccacgagacagacgagaaccgggccaagguggaaaucacccccaacagcccuagagccgaggccacacugggcggcuuuggaucucugggccuggacugcgagccuagaaccggccuggauuucagcgaccuguacuaccugaccaugaacaacaagcacuggcuggugcacaaagagugguuccacgacaucccccugcccuggcaugcuggcgcugauacaggcaccccccacuggaacaacaaagaggcucugguggaauucaaggacgcccacgccaagcggcagaccgugguggugcugggaucucaggaaggcgccgugcauacagcucuggcuggcgcccuggaagccgaaauggauggcgccaaaggcagacuguccuccggccaccugaagugccggcugaagauggacaagcugcggcugaagggcguguccuacagccuguguaccgccgccuucaccuucaccaagauccccgccgagacacugcacggcaccgugacuguggaagugcaguacgccggcaccgacggcccuuguaaagugccugcucagauggccguggauaugcagacccugacccccgugggcagacugaucaccgccaacccugugaucaccgagagcaccgagaacagcaagaugaugcuggaacuggacccccccuucggcgacuccuacaucgugaucggcgugggagagaagaagaucacccaccacuggcacagauccggcagcaccaucggcaaggccuuugaggcuacagugcggggagccaagagaauggccgugcugggcgauaccgccugggauuuuggcucugugggcggagcccugaacagccugggaaagggcauccaccagaucuucggcgcugccuucaagagccuguucggcggcaugagcugguucagccagauccugaucggcacccugcucguguggcugggccugaacaccaagaacggcagcaucucccugaccugccuggcucugggcggcgugcugaucuuucugagcacagccguguccgcc

SEQ ID NO: 156 - protein, 794 aa, Zika Virus
MKNPKEEIRRIRIVNMLKRGVARVSPFGGLKRLPAGLLLGHGPIRMVLAILAFLRFTAIKPSLGLINRWGSVGKKEAMEIIKKFKKDLAAMLRIINARKEKKRRGTDTSVGIVGLLLTTAMAVEVTRRGSAYYMYLDRSDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPAVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLVWLGLNTKNGSISLTCLALGGVLIFLSTAVSA

SEQ ID NO: 157 - protein, 788 aa, Zika Virus
MKNPKKKSGGFRIVNMLKRGVARVNPLGGLKRLPAGLLLGHGPIRMVLAILAFLRFTAIKPSLGLINRWGTVGKKEAMEIIKKFKKDLAAMLRIINARKERKRRGADTSIGIVGLLLTTAMAAEITRRGSAYYMYLDRSDAGKAISFATTLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFTLVAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIVNDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKVPAQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSA

SEQ ID NO: 158 - protein, 794 aa, Zika Virus
MKNPKRAGSSRLVNMLRRGAARVIPPGGGLKRLPVGLLLGRGPIKMILAILAFLRFTAIKPSTGLINRWGKVGKKEAIKILTKFKADVGTMLRIINNRKTKKRGVETGIVFLALLVSIVAVEVTKKGDTYYMFADKKDAGKVVTFETESGPNRCSIQAMDIGHMCPATMSYECPVLEPQYEPEDVDCWCNSTAAWIVYGTCTHKTTGETRRSRRSITLPSHASQKLETRSSTWLESREYSKYLIKVENWILRNPGYALVAAVIGWTLGSSRSQKIIFVTLLMLVAPAYSIRCIGIGNRDFIEGMSGGTWVDIVLEHGGCVTVMSNDKPTLDFELVTTTASNMAEVRSYCYEANISEMASDSRCPTQGEAYLDKMADSQFVCKRGYVDRGWGNGCGLFGKGSIVTCAKFTCVKKLTGKSIQPENLEYRVLVSVHASQHGGMINNDTNHQHDKENRARIDITASAPRVEVELGSFGSFSMECEPRSGLNFGDLYYLTMNNKHWLVNRDWFHDLSLPWHTGATSNNHHWNNKEALVEFREAHAKKQTAVVLGSQEGAVHAALAGALEAESDGHKATIYSGHLKCRLKLDKLRLKGMSYALCTGAFTFARTPSETIHGTATVELQYAGEDGPCKVPIVITSDTNSMASTGRLITANPVVTESGANSKMMVEIDPPFGDSYIIVGTGTTKITHHWHRAGSSIGRAFEATMRGAKRMAVLGDTAWDFGSVGGMFNSVGKFVHQVFGSAFKALFGGMSWFTQLLIGFLLIWMGLNARGGTVAMSFMGIGAMLIFLATSVSG

SEQ ID NO: 159 - protein, 790 aa, Zika Virus
MKNPKEEIRRIRIVNMLKRGVARVNPLGGLKRLPAGLLLGHGPIRMVLAILAFLRFTAIKPSLGLINRWGSVGKKEAMEIIKKFKKDLAAMLRIINARKERKRRGADTSIGIIGLLLTTAMAAEITRRGSAYYMYLDRSDAGKAISFATTLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFALVAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIGYETDEDRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKIPVQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSA

SEQ ID NO: 160 - protein, 789 aa, Zika Virus
MKNPKEEIRRIRIVNMLKRGVARVNPLGGLKRLPAGLLLGHGPIRMVLAILAFLRFTAIKPSLGLINRWGSVGKKEAMEIIKKFKKDLAAMLRIINARKERKRRGADTSIGIIGLLLTTAMAAEITRRGSAYYMYLDRSDAGKAISFATTLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFALVAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCKKMTGKSIQPENLEYRIMLSVHGSQHSGMIGYETDEDRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKIPVQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSA

SEQ ID NO: 161 - protein, 794 aa, Zika Virus
MKNPKKKSGGFRIVNMLKRGVARVNPLGGLKRLPAGLLLGHGPIRMVLAILAFLRFTAIKPSLGLINRWGSVGKKEAMEIIKKFKKDLAAMLRIINARKERKRRGADTSIGIIGLLLTTAMAAEITRRGSAYYMYLDRSDAGKAISFATNLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFALAAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIVNDIGHETDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKVPAQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGVHQIFGAAFKSLFGGMSWFSQILIGTLLVWLGLNTKNGSISLTCLALGGVMIFLSTAVSA

SEQ ID NO: 162 - protein, 788 aa, Zika Virus
MKNPKKKSGGFRIVNMLKRGVARVNPLGGLKRLPAGLLLGHGPIRMVLAILAFLRFTAIKPSLGLINRWGSVGKKEAMEIIKKFKKDLAAMLRIINARKERKRRGADTSIGIIGLLLTTAMAAEITRRGSAYYMYLDRSDAGKAISFATNLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFALAAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIVNDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKVPAQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSA

SEQ ID NO: 163 - protein, 794 aa, Zika Virus; identical to SEQ ID NO: 161

SEQ ID NO: 164 - protein, 794 aa, Zika Virus
  misc_feature (446)..(452): Xaa can be any naturally occurring amino acid
MKNPKKKSGGFRIVNMLKRGVARVNPLGGLKRLPAGLLLGHGPIRMVLAILAFLRFTAIKPSLGLINRWGSVGKKEAMEIIKKFKKDLAAMLRIINARKERKRRGADTSIGIIGLLLTTAMAAEITRRGSAYYMYLDRSDAGKAISFATTLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFALAAVAIAWLLGSSTSQKVIYLIMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIVNDXXXXXXXNRAEVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKVPAQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSA

SEQ ID NO: 165 - protein, 794 aa, Zika Virus
MKNPKKRSGGFRIVNMLKRGVARVNPLGGLKRLPAGLLLGHGPIRMVLAILAFLRFTAIKPSLGLINRWGSVGKKEAMEIIKKFKKDLAAMLRIINARKERKRRGADTSIGIVGLLLTTAMAAEITRRGSAYYMYLDRSDAGKAISFATTLGVNKCHVQIMDLGHMCDATMSYECPMLDEGVEPDDVDCWCNTTSTWVVYGTCQHKKGEARRSRRAVTLPSHSTRKLQTRSQTWLESREYTKHLIKVENWIFRNPGFALVAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIVNDIGHETDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAVCTAAKVPAETLHGTVTVEVQYAGTDGPCKVPAQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSA

SEQ ID NO: 166 - protein, 794 aa, Zika Virus
MKNPKKKSGRFRIVNMLKRGVARVNPLGGLKRLPAGLLLGHGPIRMVLAILAFLRFTAIKPSLGLINRWGSVGKKEAMEIIKKFKKDLAAMLRIINARKERKRRGADTSIGIIGLLLTTAMAAEITRRGSAYYMYLDRSDAGKAISFATTLGVNKCHVQIMDLGHMCDATMSYECPMLDEGVEPDDVDCWCNTTSTWVVYGTCHHKKGETRRSRRSVSLRYHYTRKLQTRSQTWLESREYKKHLIMVENWIFRNPGFAIVSVAITWLMGSLTSQKVIYLVMIVLIVPAYSISCIGVSNRDLVEGMSGGTWVDVVLEHGGCVTEMAQDKPTVDIELVTMTVSNMAEVRSYCYEASLSDMASASRCPTQGEPSLDKQSDTQSVCKRTLGDRGWGNGCGIFGKGSLVTCSKFTCCKKMPGKSIQPENLEYRIMLPVHGSQHSGMIVNDIGHETDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQSAGTDGPCKVPAQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSA

SEQ ID NO: 167 - protein, 794 aa, Zika Virus
  misc_feature (442)..(446): Xaa can be any naturally occurring amino acid
MKNPKRKSGGFRIVNMLKRGVARVNPLGGLKRLPAGLLLGHGPIRMVLAILAFLRFTAIKPSLGLINRWGSVGKKEAMEIIKKFKKDLAAMLRIINARKERKRRGADTSIGIIGLLLTTAMAAEITRRGSAYYMYLDRSDAGKAISFATTLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFALAAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMXXXXXGHETDENRAKVEVTPNSPRAEATLGGFGSLGLDCEPRTGLDFSDLYYLTMNNKHRLVRKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKVPAQMAVDMQTLTPVGRLITANPVITESTENSKMMLELDPPFGDSYIVIGVGDKKITHHWLKKGSSIGKAFEATVRGAKRMAVLGDTAWDFGSVGGVFNSLGKGVHQIFGAAFKSLFGGMSWFSQILIGTLLVWLGLNTKNGSISLTCLALGGVMIFLSTAVSA

SEQ ID NO: 168 - protein, 794 aa, Zika Virus
MKNPKKKSGGFRIVNMLKRGVARVNPLGGLKRLPAGLLLGHGPIRMVLAILAFLRFTAIKPSLGLINRWGSVGKKEAMEIIKKFKKDLAAMLRIINARKERKRRGADTSIGIIGLLLTTAMAAEITRRGSAYYMYLDRSDAGKAISFATTLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFALVAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIVNDIGHETDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKVPAQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSA

SEQ ID NO: 169 - protein, 794 aa, Zika Virus
MKNPKKKSGGFRIVNMLKRGVARVSPFGGLKRLPAGLLLGHGPIRMVLAILAFLRFTAIKPSLGLINRWGSVGKKEAMEIIKKFKKDLAAMLRIINARKEKKRRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 170 - protein, 794 aa, Zika Virus
MKNPKKKSGGFRIVNMLKRGVARVNPLGGLKRLPAGLLLGHGPIRMVLAILAFLRFTAIKPSLGLINRWGSVGKKEAMEIIKKFKKDLAAMLRIINARKERKRRGADTSIGIIGLLLTTAMAAEITRRGSAYYMYLDRSDAGKAISFATTLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFALVAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMTVNDIGYETDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGKLFSGHLKCRLKMDKLRLKGVSYSLCTAAFTFTKVPAETLHGTVTVEVQYAGTDGPCKIPVQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSA

SEQ ID NO: 171 - protein, 674 aa, Zika Virus
VEVTKKGDTYYMFADKKDAGKVVTFETESGPNRCSIQAMDIGHMCPATMSYECPVLEPQYEPEDVDCWCNSTAAWIVYGTCTHKTTGETRRSRRSITLPSHASQKLETRSSTWLESREYSKYLIKVENWILRNPGYALVAAVIGWTLGSSRSQKIIFVTLLMLVAPAYSIRCIGIGNRDFIEGMSGGTWVDIVLEHGGCVTVMSNDKPTLDFELVTTTASNMAEVRSYCYEANISEMASDSRCPTQGEAYLDKMADSQFVCKRGYVDRGWGNGCGLFGKGSIVTCAKFTCVKKLTGKSIQPENLEYRVLVSVHASQHGGMINNDTNHQHDKENRARIDITASAPRVEVELGSFGSFSMECEPRSGLNFGDLYYLTMNNKHWLVNRDWFHDLSLPWHTGATSNNHHWNNKEALVEFREAHAKKQTAVVLGSQEGAVHAALAGALEAESDGHKATIYSGHLKCRLKLDKLRLKGMSYALCTGAFTFARTPSETIHGTATVELQYAGEDGPCKVPIVITSDTNSMASTGRLITANPVVTESGANSKMMVEIDPPFGDSYIIVGTGTTKITHHWHRAGSSIGRAFEATMRGAKRMAVLGDTAWDFGSVGGMFNSVGKFVHQVFGSAFKALFGGMSWFTQLLIGFLLIWMGLNARGGTVAMSFMGIGAMLIFLATSVSG

SEQ ID NO: 172 - protein, 668 aa, Zika Virus
AEITRRGSAYYMYLDRSDAGKAISFATTLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFALVAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIGYETDEDRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKIPVQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSA

SEQ ID NO: 173 - protein, 672 aa, Zika Virus
AEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 174 - protein, 672 aa, Zika Virus
AEITRRGSAYYMYLDRSDAGKAISFATTLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFALVAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIVNDIGHETDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKVPAQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSA

SEQ ID NO: 175 - protein, 672 aa, Zika Virus
AEITRRGSAYYMYLDRSDAGKAISFATTLGVNKCHVQIMDLGHMCDATMSYECPMLDEGVEPDDVDCWCNTTSTWVVYGTCHHKKGETRRSRRSVSLRYHYTRKLQTRSQTWLESREYKKHLIMVENWIFRNPGFAIVSVAITWLMGSLTSQKVIYLVMIVLIVPAYSISCIGVSNRDLVEGMSGGTWVDVVLEHGGCVTEMAQDKPTVDIELVTMTVSNMAEVRSYCYEASLSDMASASRCPTQGEPSLDKQSDTQSVCKRTLGDRGWGNGCGIFGKGSLVTCSKFTCCKKMPGKSIQPENLEYRIMLPVHGSQHSGMIVNDIGHETDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQSAGTDGPCKVPAQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSA

SEQ ID NO: 176 - protein, 673 aa, Zika Virus
  misc_feature (321)..(325): Xaa can be any naturally occurring amino acid
AAEITRRGSAYYMYLDRSDAGKAISFATTLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFALAAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMXXXXXGHETDENRAKVEVTPNSPRAEATLGGFGSLGLDCEPRTGLDFSDLYYLTMNNKHRLVRKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKVPAQMAVDMQTLTPVGRLITANPVITESTENSKMMLELDPPFGDSYIVIGVGDKKITHHWLKKGSSIGKAFEATVRGAKRMAVLGDTAWDFGSVGGVFNSLGKGVHQIFGAAFKSLFGGMSWFSQILIGTLLVWLGLNTKNGSISLTCLALGGVMIFLSTAVSA

SEQ ID NO: 177 - protein, 672 aa, Zika Virus
AEITRRGSAYYMYLDRSDAGKAISFATTLGVNKCHVQIMDLGHMCDATMSYECPMLDEGVEPDDVDCWCNTTSTWVVYGTCQHKKGEARRSRRAVTLPSHSTRKLQTRSQTWLESREYTKHLIKVENWIFRNPGFALVAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIVNDIGHETDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAVCTAAKVPAETLHGTVTVEVQYAGTDGPCKVPAQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSA

SEQ ID NO: 178 - protein, 672 aa, Zika Virus
  misc_feature (324)..(330): Xaa can be any naturally occurring amino acid
AEITRRGSAYYMYLDRSDAGKAISFATTLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFALAAVAIAWLLGSSTSQKVIYLIMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIVNDXXXXXXXNRAEVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKVPAQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSA

SEQ ID NO: 179 - protein, 672 aa, Zika Virus
AEITRRGSAYYMYLDRSDAGKAISFATNLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFALAAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIVNDIGHETDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKVPAQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGVHQIFGAAFKSLFGGMSWFSQILIGTLLVWLGLNTKNGSISLTCLALGGVMIFLSTAVSA

SEQ ID NO: 180 - protein, 666 aa, Zika Virus
AEITRRGSAYYMYLDRSDAGKAISFATNLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFALAAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIVNDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKVPAQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSA

SEQ ID NO: 181 - protein, 672 aa, Zika Virus; identical to SEQ ID NO: 179

SEQ ID NO: 182 - protein, 672 aa, Zika Virus
VEVTRRGSAYYMYLDRSDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPAVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLVWLGLNTKNGSISLTCLALGGVLIFLSTAVSA

SEQ ID NO: 183 - protein, 666 aa, Zika Virus
AEITRRGSAYYMYLDRSDAGKAISFATTLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFTLVAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIVNDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKVPAQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSA

SEQ ID NO: 184 - protein, 668 aa, Zika Virus; identical to SEQ ID NO: 172

SEQ ID NO: 185 - protein, 672 aa, Zika Virus
AEITRRGSAYYMYLDRSDAGKAISFATTLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFALVAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMTVNDIGYETDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGKLFSGHLKCRLKMDKLRLKGVSYSLCTAAFTFTKVPAETLHGTVTVEVQYAGTDGPCKIPVQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSA

SEQ ID NO: 186 - protein, 672 aa, Zika Virus; identical to SEQ ID NO: 173

SEQ ID NO: 187 - protein, 672 aa, Zika Virus; identical to SEQ ID NO: 173

SEQ ID NO: 188 - protein, 672 aa, Zika Virus; identical to SEQ ID NO: 173

SEQ ID NO: 189 - protein, 672 aa, Zika Virus; identical to SEQ ID NO: 173

SEQ ID NO: 190 - protein, 672 aa, Zika Virus
AEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 191 - protein, 672 aa, Zika Virus
AEVTRRGSAYYMYLDRNDAGEAISFPTTLGMNKCYIQIMDLGHTCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNAKNGSISLMCLALGGVLIFLSTAVSA

SEQ ID NO: 192 - protein, 504 aa, Zika Virus
IRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 193 - protein, 125 aa, Zika Virus
MKNPKKKSGGFRIVNMLKRGVARVSPFGGLKRLPAGLLLGHGPIRMVLAILAFLRFTAIKPSLGLINRWGSVGKKEAMEIIKKFKKDLAAMLRIINARKEKKRRGADTSVGIVGLLLTTAMAAEV

SEQ ID NO: 194 - protein, 362 aa, Zika Virus
VGCSVDFSKKETRCGTGVFVYNDVEAWRDRYKYHPDSPRRLAAAVKQAWEDGICGISSVSRMENIMWRSVEGELNAILEENGVQLTVVVGSVKNPMWRGPQRLPVPVNELPHGWKAWGKSHFVRAAKTNNSFVVDGDTLKECPLKHRAWNSFLVEDHGFGVFHTSVWLKVREDYSLECDPAVIGTAVKGKEAVHSDLGYWIESEKNDTWRLKRAHLIEMKTCEWPKSHTLWTDGIEESDLIIPKSLAGPLSHHNTREGYRTQMKGPWHSEELEIRFEECPGTKVHVEETCGTRGPSLRSTTASGRVIEEWCCRECTMPPLSFRAKDGCWYGMEIRPRKEPESNLVRSMVTAGSTDHMDHFSL

SEQ ID NO: 195 - protein, 218 aa, Zika Virus
GVLVILLMVQEGLKKRMTTKIIISTSMAVLVAMILGGFSMSDLAKLAILMGATFAEMNTGGDVAHLALIAAFKVRPALLVSFIFRANWTPRESMLLALASCLLQTAISALEGDLMVLINGFALAWLAIRAMVVPRTDNITLAILAALTPLARGTLLVAWRAGLATCGGFMLLSLKGKGSVKKNLPFVMALGLTAVRLVDPINVVGLLLLTRSGKRSWP

SEQ ID NO: 196 - protein, 144 aa, Zika Virus
PSEVLTAVGLICALAGGFAKADIEMAGPMAAVGLLIVSYVVSGKSVDMYIERAGDITWEKDAEVTGNSPRLDVALDESGDFSLVEDDGPPMREIILKVVLMTICGMNPIAIPFAAGAWYVYVKTGKRSGALWDVPAPKEVKKGE

SEQ ID NO: 197 - protein, 603 aa, Zika Virus
TTDGVYRVMTRRLLGSTQVGVGVMQEGVFHTMWHVTKGSALRSGEGRLDPYWGDVKQDLVSYCGPWKLDAAWDGHSEVQLLAVPPGERARNIQTLPGIFKTKDGDIGAVALDYPAGTSGSPILDKCGRVIGLYGNGVVIKNGSYVSAITQGRREEETPVECFEPSMLKKKQLTVLDLHPGAGKTRRVLPEIVREAIKTRLRTVILAPTRVVAAEMEEALRGLPVRYMTTAVNVTHSGTEIVDLMCHATFTSRLLQPIRVPNYNLYIMDEAHFTDPSSIAARGYISTRVEMGEAAAIFMTATPPGTRDAFPDSNSPIMDTEVEVPERAWSSGFDWVTDYSGKTVWFVPSVRNGNEIAACLTKAGKRVIQLSRKTFETEFQKTKHQEWDFVVTTDISEMGANFKADRVIDSRRCLKPVILDGERVILAGPMPVTHASAAQRRGRIGRNPNKPGDEYLYGGGCAETDEDHAHWLEARMLLDNIYLQDGLIASLYRPEADKVAAIEGEFKLRTEQRKTFVELMKRGDLPVWLAYQVASAGITYTDRRWCFDGTTNNTIMEDSVPAEVWTRHGEKRVLKPRWMDARVCSDHAALKSFKEFAAGKRGAA

SEQ ID NO: 198 - protein, 147 aa, Zika Virus
FGVMEALGTLPGHMTERFQEAIDNLAVLMRAETGSRPYKAAAAQLPETLETIMLLGLLGTVSLGIFFVLMRNKGIGKMGFGMVTLGASAWLMWLSEIEPARIACVLIVVFLLLVVLIPEPEKQRSPQDNQMAIIIMVAVGLLGLITA

SEQ ID NO: 199 - protein, 502 aa, Zika Virus
NELGWLERTKSDLSHLMGRREEGATMGFSMDIDLRPASAWAIYAALTTFITPAVQHAVTTSYNNYSLMAMATQAGVLFGMGKGMPFYAWDFGVPLLMIGCYSQLTPLTLIVAIILLVAHYMYLIPGLQAAAARAAQKRTAAGIMKNPVVDGIVVTDIDTMTIDPQVEKKMGQVLLMAVAVSSAILSRTAWGWGEAGALITAATSTLWEGSPNKYWNSSTATSLCNIFRGSYLAGASLIYTVTRNAGLVKRRGGGTGETLGEKWKARLNQMSALEFYSYKKSGITEVCREEARRALKDGVATGGHAVSRGSAKLRWLVERGYLQPYGKVIDLGCGRGGWSYYAATIRKVQEVKGYTKGGPGHEEPVLVQSYGWNIVRLKSGVDVFHMAAEPCDTLLCDIGESSSSPEVEEARTLRVLSMVGDWLEKRPGAFCIKVLCPYTSTMMETLERLQRRYGGGLVRVPLSRNSTHEMYWVSGAKSNTIKSVSTTSQLLLGRMDGPRRPV

SEQ ID NO: 200 - protein, 652 aa, Zika Virus
KYEEDVNLGSGTRAVVSCAEAPNMKIIGNRIERIRSEHAETWFFDENHPYRTWAYHGSYEAPTQGSASSLINGVVRLLSKPWDVVTGVTGIAMTDTTPYGQQRVFKEKVDTRVPDPQEGTRQVMSMVSSWLWKELGKHKRPRVCTKEEFINKVRSNAALGAIFEEEKEWKTAVEAVNDPRFWALVDKEREHHLRGECQSCVYNMMGKREKKQGEFGKAKGSRAIWYMWLGARFLEFEALGFLNEDHWMGRENSGGGVEGLGLQRLGYVLEEMSRIPGGRMYADDTAGWDTRISRFDLENEALITNQMEKGHRALALAIIKYTYQNKVVKVLRPAEKGKTVMDIISRQDQRGSGQVVTYALNTFTNLVVQLIRNMEAEEVLEMQDLWLLRRSEKVTNWLQSNGWDRLKRMAVSGDDCVVKPIDDRFAHALRFLNDMGKVRKDTQEWKPSTGWDNWEEVPFCSHHFNKLHLKDGRSIVVPCRHQDELIGRARVSPGAGWSIRETACLAKSYAQMWQLLYFHRRDLRLMANAICSSVPVDWVPTGRTTWSIHGKGEWMTTEDMLVVWNRVWIEENDHMEDKTPVTKWTDIPYLGKREDLWCGSLIGHRPRTTWAENIKNTVNMVRRIIGDEEKYMDYLSTQVRYLGEEGSTPGVL

SEQ ID NO: 201 - protein, 692 aa, Zika Virus
METPAQLLFLLLLWLPDTTGAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 202 - protein, 524 aa, Zika Virus
METPAQLLFLLLLWLPDTTGIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 203 - protein, 690 aa, Zika Virus
MDWTWILFLVAAATRVHSVEVTRRGSAYYMYLDRSDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPAVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLVWLGLNTKNGSISLTCLALGGVLIFLSTAVSA

SEQ ID NO: 204 - protein, 690 aa, Zika Virus; identical to SEQ ID NO: 203

SEQ ID NO: 205 - protein, 687 aa, Zika Virus
MDWTWILFLVAAATRVHSTRRGSAYYMYLDRSDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPAVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLVWLGLNTKNGSISLTCLALGGVLIFLSTAVSA

SEQ ID NO: 206 - protein, 692 aa, Zika Virus
METPAQLLFLLLLWLPDTTGVEVTRRGSAYYMYLDRSDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPAVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLVWLGLNTKNGSISLTCLALGGVLIFLSTAVSA

SEQ ID NO: 207 - protein, 689 aa, Zika Virus
METPAQLLFLLLLWLPDTTGTRRGSAYYMYLDRSDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPAVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLVWLGLNTKNGSISLTCLALGGVLIFLSTAVSA

SEQ ID NO: 208 - protein, 524 aa, Zika Virus
METPAQLLFLLLLWLPDTTGIRCIGVSNRDFVEGMSGGTWVDVVLEHGGCVTVMAQDKPAVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLVWLGLNTKNGSISLTCLALGGVLIFLSTAVSA

SEQ ID NO: 209 - protein, 687 aa, Zika Virus; identical to SEQ ID NO: 205

SEQ ID NO: 210 - protein, 692 aa, Zika Virus; identical to SEQ ID NO: 206

SEQ ID NO: 211 - protein, 689 aa, Zika Virus; identical to SEQ ID NO: 207

SEQ ID NO: 212 - protein, 524 aa, Zika Virus; identical to SEQ ID NO: 208

SEQ ID NO: 213 - protein, 672 aa, Zika Virus; identical to SEQ ID NO: 173

SEQ ID NO: 214 - protein, 696 aa, Zika Virus
MLGSNSGQRVVFTILLLLVAPAYSAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 215 - protein, 671 aa, Zika Virus
EVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 216 - protein, 688 aa, Zika Virus
MKCLLYLAFLFIGVNCAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 217 - protein, 672 aa, Artificial Sequence
  Synthetic Polynucleotide
VEVTRRGSAYYMYLDRSDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPAVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVADTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLVWLGLNTKNGSISLTCLALGGVLIFLSTAVSA

SEQ ID NO: 218 - protein, 690 aa, Artificial Sequence
  Synthetic Polynucleotide
MDWTWILFLVAAATRVHSVEVTRRGSAYYMYLDRSDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPAVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVADTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLVWLGLNTKNGSISLTCLALGGVLIFLSTAVSA

SEQ ID NO: 219 - protein, 687 aa, Artificial Sequence
  Synthetic Polynucleotide
MWLVSLAIVTACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 220 - protein, 672 aa, Artificial Sequence; identical to SEQ ID NO: 173
  Synthetic Polynucleotide

SEQ ID NO: 221 - protein, 687 aa, Artificial Sequence
  Synthetic Polynucleotide
MWLVSLAIVTACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPREGEAYLDKQSDTQYVCKRTLVDRGRGNGCGRFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 222 - protein, 672 aa, Artificial Sequence
  Synthetic Polynucleotide
AEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPREGEAYLDKQSDTQYVCKRTLVDRGRGNGCGRFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 223 - DNA, 10735 bp, Dengue Virus
agttgttagtctacgtggaccgacaagaacagtttcgaatcggaagcttgcttaacgtagttctaacagttttttattagagagcagatctctgatgaacaaccaacggaaaaagacgggtcgaccgtctttcaatatgctgaaacgcgcgagaaaccgcgtgtcaactgtttcacagttggcgaagagattctcaaaaggattgctttcaggccaaggacccatgaaattggtgatggcttttatagcattcctaagatttctagccatacctccaacagcaggaattttggctagatggggctcattcaagaagaatggagcgatcaaagtgttacggggtttcaagaaagaaatctcaaacatgttgaacataatgaacaggaggaaaagatctgtgaccatgctcctcatgctgctgcccacagccctggcgttccatctgaccacccgagggggagagccgcacatgatagttagcaagcaggaaagaggaaaatcacttttgtttaagacctctgcaggtgtcaacatgtgcacccttattgcaatggatttgggagagttatgtgaggacacaatgacctacaaatgcccccggatcactgagacggaaccagatgacgttgactgttggtgcaatgccacggagacatgggtgacctatggaacatgttctcaaactggtgaacaccgacgagacaaacgttccgtcgcactggcaccacacgtagggcttggtctagaaacaagaaccgaaacgtggatgtcctctgaaggcgcttggaaacaaatacaaaaagtggagacctgggctctgagacacccaggattcacggtgatagccctttttctagcacatgccataggaacatccatcacccagaaagggatcatttttattttgctgatgctggtaactccatccatggccatgcggtgcgtgggaataggcaacagagacttcgtggaaggactgtcaggagctacgtgggtggatgtggtactggagcatggaagttgcgtcactaccatggcaaaagacaaaccaacactggacattgaactcttgaagacggaggtcacaaaccctgccgtcctgcgcaaactgtgcattgaagctaaaatatcaaacaccaccaccgattcgagatgtccaacacaaggagaagccacgctggtggaagaacaggacacgaactttgtgtgtcgacgaacgttcgtggacagaggctggggcaatggttgtgggctattcggaaaaggtagcttaataacgtgtgctaagtttaagtgtgtgacaaaactggaaggaaagatagtccaatatgaaaacttaaaatattcagtgatagtcaccgtacacactggagaccagcaccaagttggaaatgagaccacagaacatggaacaactgcaaccataacacctcaagctcccacgtcggaaatacagctgacagactacggagctctaacattggattgttcacctagaacagggctagactttaatgagatggtgttgttgacaatgaaaaaaaaatcatggctcgtccacaaacaatggtttctagacttaccactgccttggacctcgggggcttcaacatcccaagagacttggaatagacaagacttgctggtcacatttaagacagctcatgcaaaaaagcaggaagtagtcgtactaggatcacaagaaggagcaatgcacactgcgttgactggagcgacagaaatccaaacgtctggaacgacaacaatttttgcaggacacctgaaatgcagattaaaaatggataaactgattttaaaagggatgtcatatgtaatgtgcacagggtcattcaagttagagaaggaagtggctgagacccagcatggaactgttctagtgcaggttaaatacgaaggaacagatgcaccatgcaagatccccttctcgtcccaagatgagaagggagtaacccagaatgggagattgataacagccaaccccatagtcactgacaaagaaaaaccagtcaacattgaagcggagccaccttttggtgagagctacattgtggtaggagcaggtgaaaaagctttgaaactaagctggttcaagaagggaagcagtatagggaaaatgtttgaagcaactgcccgtggagcacgaaggatggccatcctgggagacactgcatgggacttcggttctataggaggggtgttcacgtctgtgggaaaactgatacaccagatttttgggactgcgtatggagttttgttcagcggtgtttcttggaccatgaagataggaatagggattctgctgacatggctaggattaaactcaaggagcacgtccctttcaatgacgtgtatcgcagttggcatggtcacactgtacctaggagtcatggttcaggcggactcgggatgtgtaatcaactggaaaggcagagaactcaaatgtggaagcggcatttttgtcaccaatgaagtccacacctggacagagcaatataaattccaggccgactcccctaagagactatcagcggccattgggaaggcatgggaggagggtgtgtgtggaattcgatcagccactcgtctcgagaacatcatgtggaagcaaatatcaaatgaattaaaccacatcttacttgaaaatgacatgaaatttacagtggtcgtaggagacgttagtggaatcttggcccaaggaaagaaaatgattaggccacaacccatggaacacaaatactcgtggaaaagctggggaaaagccaaaatcataggagcagatgtacagaataccaccttcatcatcgacggcccaaacaccccagaatgccctgataaccaaagagcatggaacatttgggaagttgaagactatggatttggaattttcacgacaaacatatggttgaaattgcgtgactcctacactcaagtgtgtgaccaccggctaatgtcagctgccatcaaggatagcaaagcagtccatgctgacatggggtactggatagaaagtgaaaagaacgagacttggaagttggcaagagcctccttcatagaagttaagacatgcatctggccaaaatcccacactctatggagcaatggagtcctggaaagtgagatgataatcccaaagatatatggaggaccaatatctcagcacaactacagaccaggatatttcacacaaacagcagggccgtggcacttgggcaagttagaactagattttgatttatgtgaaggtaccactgttgttgtggatgaacattgtggaaatcgaggaccatctcttagaaccacaacagtcacaggaaagacaatccatgaatggtgctgtagatcttgcacgttaccccccctacgtttcaaaggagaagacgggtgctggtacggcatggaaatcagaccagtcaaggagaaggaagagaacctagttaagtcaatggtctctgcagggtcaggagaagtggacagtttttcactaggactgctatgcatatcaataatgatcgaagaggtaatgagatccagatggagcagaaaaatgctgatgactggaacattggctgtgttcctccttctcacaatgggacaattgacatggaatgatctgatcaggctatgtatcatggttggagccaacgcttcagacaagatggggatgggaacaacgtacctagctttgatggccactttcagaatgagaccaatgttcgcagtcgggctactgtttcgcagattaacatctagagaagttcttcttcttacagttggattgagtctggtggcatctgtagaactaccaaattccttagaggagctaggggatggacttgcaatgggcatcatgatgttgaaattactgactgattttcagtcacatcagctatgggctaccttgctgtctttaacatttgtcaaaacaactttttcattgcactatgcatggaagacaatggctatgatactgtcaattgtatctctcttccctttatgcctgtccacgacttctcaaaaaacaacatggcttccggtgttgctgggatctcttggatgcaaaccactaaccatgtttcttataacagaaaacaaaatctggggaaggaaaagctggcctctcaatgaaggaattatggctgttggaatagttagcattcttctaagttcacttctcaagaatgatgtgccactagctggcccactaatagctggaggcatgctaatagcatgttatgtcatatctggaagctcggccgatttatcactggagaaagcggctgaggtctcctgggaagaagaagcagaacactctggtgcctcacacaacatactagtggaggtccaagatgatggaaccatgaagataaaggatgaagagagagatgacacactcaccattctcctcaaagcaactctgctagcaatctcaggggtatacccaatgtcaataccggcgaccctctttgtgtggtatttttggcagaaaaagaaacagagatcaggagtgctatgggacacacccagccctccagaagtggaaagagcagtccttgatgatggcatttatagaattctccaaagaggattgttgggcaggtctcaagtaggagtaggagtttttcaagaaggcgtgttccacacaatgtggcacgtcaccaggggagctgtcctcatgtaccaagggaagagactggaaccaagttgggccagtgtcaaaaaagacttgatctcatatggaggaggttggaggtttcaaggatcctggaacgcgggagaagaagtgcaggtgattgctgttgaaccggggaagaaccccaaaaatgtacagacagcgccgggtaccttcaagacccctgaaggcgaagttggagccatagctctagactttaaacccggcacatctggatctcctatcgtgaacagagagggaaaaatagtaggtctttatggaaatggagtggtgacaacaagtggtacctacgtcagtgccatagctcaagctaaagcatcacaagaagggcctctaccagagattgaggacgaggtgtttaggaaaagaaacttaacaataatggacctacatccaggatcgggaaaaacaagaagataccttccagccatagtccgtgaggccataaaaagaaagctgcgcacgctagtcttagctcccacaagagttgtcgcttctgaaatggcagaggcgctcaagggaatgccaataaggtatcagacaacagcagtgaagagtgaacacacgggaaaggagatagttgaccttatgtgtcacgccactttcactatgcgtctcctgtctcctgtgagagttcccaattataatatgattatcatggatgaagcacattttaccgatccagccagcatagcagccagagggtatatctcaacccgagtgggtatgggtgaagcagctgcgattttcatgacagccactccccccggatcggtggaggcctttccacagagcaatgcagttatccaagatgaggaaagagacattcctgaaagatcatggaactcaggctatgactggatcactgatttcccaggtaaaacagtctggtttgttccaagcatcaaatcaggaaatgacattgccaactgtttaagaaagaatgggaaacgggtggtccaattgagcagaaaaacttttgacactgagtaccagaaaacaaaaaataacgactgggactatgttgtcacaacagacatatccgaaatgggagcaaacttccgagccgacagggtaatagacccgaggcggtgcctgaaaccggtaatactaaaagatggcccagagcgtgtcattctagccggaccgatgccagtgactgtggctagcgccgcccagaggagaggaagaattggaaggaaccaaaataaggaaggcgatcagtatatttacatgggacagcctctaaacaatgatgaggaccacgcccattggacagaagcaaaaatgctccttgacaacataaacacaccagaagggattatcccagccctctttgagccggagagagaaaagagtgcagcaatagacggggaatacagactacggggtgaagcgaggaaaacgttcgtggagctcatgagaagaggagatctacctgtctggctatcctacaaagttgcctcagaaggcttccagtactccgacagaaggtggtgctttgatggggaaaggaacaaccaggtgttggaggagaacatggacgtggagatctggacaaaagaaggagaaagaaagaaactacgaccccgctggctggatgccagaacatactctgacccactggctctgcgcgaattcaaagagttcgcagcaggaagaagaagcgtctcaggtgacctaatattagaaatagggaaacttccacaacatttaacgcaaagggcccagaacgccttggacaatctggttatgttgcacaactctgaacaaggaggaaaagcctatagacacgccatggaagaactaccagacaccatagaaacgttaatgctcctagctttgatagctgtgctgactggtggagtgacgttgttcttcctatcaggaaggggtctaggaaaaacatccattggcctactctgcgtgattgcctcaagtgcactgttatggatggccagtgtggaaccccattggatagcggcctctatcatactggagttctttctgatggtgttgcttattccagagccggacagacagcgcactccacaagacaaccagctagcatacgtggtgataggtctgttattcatgatattgacagtggcagccaatgagatgggattactggaaaccacaaagaaggacctggggattggtcatgcagctgctgaaaaccaccatcatgctgcaatgctggacgtagacctacatccagcttcagcctggactctctatgcagtggccacaacaattatcactcccatgatgagacacacaattgaaaacacaacggcaaatatttccctgacagctattgcaaaccaggcagctatattgatgggacttgacaagggatggccaatatcaaagatggacataggagttccacttctcgccttggggtgctattctcaggtgaacccgctgacgctgacagcggcggtattgatgctagtggctcattatgccataattggacccggactgcaagcaaaagctactagagaagctcaaaaaaggacagcagccggaataatgaaaaacccaactgtcgacgggatcgttgcaatagatttggaccctgtggtttacgatgcaaaatttgaaaaacagctaggccaaataatgttgttgatactttgcacatcacagatcctcctgatgcggaccacatgggccttgtgtgaatccatcacactagccactggacctctgactacgctttgggagggatctccaggaaaattctggaacaccacgatagcggtgtccatggcaaacatttttaggggaagttatctagcaggagcaggtctggccttttcattaatgaaatctctaggaggaggtaggagaggcacgggagcccaaggggaaacactgggagaaaaatggaaaagacagctaaaccaattgagcaagtcagaattcaacacttacaaaaggagtgggattatagaggtggatagatctgaagccaaagaggggttaaaaagaggagaaacgactaaacacgcagtgtcgagaggaacggccaaactgaggtggtttgtggagaggaaccttgtgaaaccagaagggaaagtcatagacctcggttgtggaagaggtggctggtcatattattgcgctgggctgaagaaagtcacagaagtgaaaggatacacgaaaggaggacctggacatgaggaaccaatcccaatggcaacctatggatggaacctagtaaagctatactccgggaaagatgtattctttacaccacctgagaaatgtgacaccctcttgtgtgatattggtgagtcctctccgaacccaactatagaagaaggaagaacgttacgtgttctaaagatggtggaaccatggctcagaggaaaccaattttgcataaaaattctaaatccctatatgccgagtgtggtagaaactttggagcaaatgcaaagaaaacatggaggaatgctagtgcgaaatccactctcaagaaactccactcatgaaatgtactgggtttcatgtggaacaggaaacattgtgtcagcagtaaacatgacatctagaatgctgctaaatcgattcacaatggctcacaggaagccaacatatgaaagagacgtggacttaggcgctggaacaagacatgtggcagtagaaccagaggtggccaacctagatatcattggccagaggatagagaatataaaaaatgaacacaaatcaacatggcattatgatgaggacaatccatacaaaacatgggcctatcatggatcatatgaggtcaagccatcaggatcagcctcatccatggtcaatggtgtggtgagactgctaaccaaaccatgggatgtcattcccatggtcacacaaatagccatgactgacaccacaccctttggacaacagagggtgtttaaagagaaagttgacacgcgtacaccaaaagcgaaacgaggcacagcacaaattatggaggtgacagccaggtggttatggggttttctctctagaaacaaaaaacccagaatctgcacaagagaggagttcacaagaaaagtcaggtcaaacgcagctattggagcagtgttcgttgatgaaaatcaatggaactcagcaaaagaggcagtggaagatgaacggttctgggaccttgtgcacagagagagggagcttcataaacaaggaaaatgtgccacgtgtgtctacaacatgatgggaaagagagagaaaaaattaggagagttcggaaaggcaaaaggaagtcgcgcaatatggtacatgtggttgggagcgcgctttttagagtttgaagcccttggtttcatgaatgaagatcactggttcagcagagagaattcactcagtggagtggaaggagaaggactccacaaacttggatacatactcagagacatatcaaagattccagggggaaatatgtatgcagatgacacagccggatgggacacaagaataacagaggatgatcttcagaatgaggccaaaatcactgacatcatggaacctgaacatgccctattggccacgtcaatctttaagctaacctaccaaaacaaggtagtaagggtgcagagaccagcgaaaaatggaaccgtgatggatgtcatatccagacgtgaccagagaggaagtggacaggttggaacctatggcttaaacaccttcaccaacatggaggcccaactaataagacaaatggagtctgagggaatcttttcacccagcgaattggaaaccccaaatctagccgaaagagtcctcgactggttgaaaaaacatggcaccgagaggctgaaaagaatggcaatcagtggagatgactgtgtggtgaaaccaatcgatgacagatttgcaacagccttaacagctttgaatgacatgggaaaggtaagaaaagacataccgcaatgggaaccttcaaaaggatggaatgattggcaacaagtgcctttctgttcacaccatttccaccagctgattatgaaggatgggagggagatagtggtgccatgccgcaaccaagatgaacttgtaggtagggccagagtatcacaaggcgccggatggagcttgagagaaactgcatgcctaggcaagtcatatgcacaaatgtggcagctgatgtacttccacaggagagacttgagattagcggctaatgctatctgttcagccgttccagttgattgggtcccaaccagccgcaccacctggtcgatccatgcccaccatcaatggatgacaacagaagacatgttgtcagtgtggaatagggtttggatagaggaaaacccatggatggaggacaagactcatgtgtccagttgggaagacgttccatacctaggaaaaagggaagatcaatggtgtggttccctaataggcttaacagcacgagccacctgggccaccaacatacaagtggccataaaccaagtgagaaggctcattgggaatgagaattatctagacttcatgacatcaatgaagagattcaaaaacgagagtgatcccgaaggggcactctggtaagccaactcattcacaaaataaaggaaaataaaaaatcaaacaaggcaagaagtcaggccggattaagccatagcacggtaagagctatgctgcctgtgagccccgtccaaggacgtaaaatgaagtcaggccgaaagccacggttcgagcaagccgtgctgcctgtagctccatcgtggggatgtaaaaacccgggaggctgcaaaccatggaagctgtacgcatggggtagcagactagtggttagaggagacccctcccaagacacaacgcagcagcggggcccaacaccaggggaagctgtaccctggtggtaaggactagaggttagaggagaccccccgcacaacaacaaacagcatattgacgctgggagagaccagagatcctgctgtctctacagcatcattccaggcacagaacgccaaaaaatggaatggtgctgttgaatcaacaggttct

SEQ ID NO: 224 - DNA, 10723 bp, Dengue Virus
agttgttagtctacgtggaccgacaaagacagattctttgagggagctaagctcaacgtagttctaacagttttttaattagagagcagatctctgatgaataaccaacggaaaaaggcgaaaaacacgcctttcaatatgctgaaacgcgagagaaaccgcgtgtcgactgtgcaacagctgacaaagagattctcacttggaatgctgcagggacgaggaccattaaaactgttcatggccctggtggcgttccttcgtttcctaacaatcccaccaacagcagggatattgaagagatggggaacaattaaaaaatcaaaagctattaatgttttgagagggttcaggaaagagattggaaggatgctgaacatcttgaataggagacgcagatctgcaggcatgatcattatgctgattccaacagtgatggcgttccatttaaccacacgtaacggagaaccacacatgatcgtcagcagacaagagaaagggaaaagtcttctgtttaaaacagaggatggcgtgaacatgtgtaccctcatggccatggaccttggtgaattgtgtgaagacacaatcacgtacaagtgtccccttctcaggcagaatgagccagaagacatagactgttggtgcaactctacgtccacgtgggtaacttatgggacgtgtaccaccatgggagaacatagaagagaaaaaagatcagtggcactcgttccacatgtgggaatgggactggagacacgaactgaaacatggatgtcatcagaaggggcctggaaacatgtccagagaattgaaacttggatcttgagacatccaggcttcaccatgatggcagcaatcctggcatacaccataggaacgacacatttccaaagagccctgattttcatcttactgacagctgtcactccttcaatgacaatgcgttgcataggaatgtcaaatagagactttgtggaaggggtttcaggaggaagctgggttgacatagtcttagaacatggaagctgtgtgacgacgatggcaaaaaacaaaccaacattggattttgaactgataaaaacagaagccaaacagcctgccaccctaaggaagtactgtatagaggcaaagctaaccaacacaacaacagaatctcgctgcccaacacaaggggaacccagcctaaatgaagagcaggacaaaaggttcgtctgcaaacactccatggtagacagaggatggggaaatggatgtggactatttggaaagggaggcattgtgacctgtgctatgttcagatgcaaaaagaacatggaaggaaaagttgtgcaaccagaaaacttggaatacaccattgtgataacacctcactcaggggaagagcatgcagtcggaaatgacacaggaaaacatggcaaggaaatcaaaataacaccacagagttccatcacagaagcagaattgacaggttatggcactgtcacaatggagtgctctccaagaacgggcctcgacttcaatgagatggtgttgctgcagatggaaaataaagcttggctggtgcacaggcaatggttcctagacctgccgttaccatggttgcccggagcggacacacaagggtcaaattggatacagaaagagacattggtcactttcaaaaatccccatgcgaagaaacaggatgttgttgttttaggatcccaagaaggggccatgcacacagcacttacaggggccacagaaatccaaatgtcatcaggaaacttactcttcacaggacatctcaagtgcaggctgagaatggacaagctacagctcaaaggaatgtcatactctatgtgcacaggaaagtttaaagttgtgaaggaaatagcagaaacacaacatggaacaatagttatcagagtgcaatatgaaggggacggctctccatgcaagatcccttttgagataatggatttggaaaaaagacatgtcttaggtcgcctgattacagtcaacccaattgtgacagaaaaagatagcccagtcaacatagaagcagaacctccattcggagacagctacatcatcataggagtagagccgggacaactgaagctcaactggtttaagaaaggaagttctatcggccaaatgtttgagacaacaatgaggggggcgaagagaatggccattttaggtgacacagcctgggattttggatccttgggaggagtgtttacatctataggaaaggctctccaccaagtctttggagcaatctatggagctgccttcagtggggtttcatggactatgaaaatcctcataggagtcattatcacatggataggaatgaattcacgcagcacctcactgtctgtgacactagtattggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagcccatgaagagggcatttgtggaatccgctcagtaacaagactggagaatctgatgtggaaacaaataacaccagaattgaatcacattctatcagaaaatgaggtgaagttaactattatgacaggagacatcaaaggaatcatgcaggcaggaaaacgatctctgcggcctcagcccactgagctgaagtattcatggaaaacatggggcaaagcaaaaatgctctctacagagtctcataaccagacctttctcattgatggccccgaaacagcagaatgccccaacacaaatagagcttggaattcgttggaagttgaagactatggctttggagtattcaccaccaatatatggctaaaattgaaagaaaaacaggatgtattctgcgactcaaaactcatgtcagcggccataaaagacaacagagccgtccatgccgatatgggttattggatagaaagtgcactcaatgacacatggaagatagagaaagcctctttcattgaagttaaaaactgccactggccaaaatcacacaccctctggagcaatggagtgctagaaagtgagatgataattccaaagaatctcgctggaccagtgtctcaacacaactatagaccaggctaccatacacaaataacaggaccatggcatctaggtaagcttgagatggactttgatttctgtgatggaacaacagtggtagtgactgaggactgcggaaatagaggaccctctttgagaacaaccactgcctctggaaaactcataacagaatggtgctgccgatcttgcacattaccaccgctaagatacagaggtgaggatgggtgctggtacgggatggaaatcagaccattgaaggagaaagaagagaatttggtcaactccttggtcacagctggacatgggcaggtcgacaacttttcactaggagtcttgggaatggcattgttcctggaggaaatgcttaggacccgagtaggaacgaaacatgcaatactactagttgcagtttcttttgtgacattgatcacagggaacatgtcctttagagacctgggaagagtgatggttatggtaggcgccactatgacggatgacataggtatgggcgtgacttatcttgccctactagcagccttcaaagtcagaccaacttttgcagctggactactcttgagaaagctgacctccaaggaattgatgatgactactataggaattgtactcctctcccagagcaccataccagagaccattcttgagttgactgatgcgttagccttaggcatgatggtcctcaaaatggtgagaaatatggaaaagtatcaattggcagtgactatcatggctatcttgtgcgtcccaaacgcagtgatattacaaaacgcatggaaagtgagttgcacaatattggcagtggtgtccgtttccccactgctcttaacatcctcacagcaaaaaacagattggataccattagcattgacgatcaaaggtctcaatccaacagctatttttctaacaaccctctcaagaaccagcaagaaaaggagctggccattaaatgaggctatcatggcagtcgggatggtgagcattttagccagttctctcctaaaaaatgatattcccatgacaggaccattagtggctggagggctcctcactgtgtgctacgtgctcactggacgatcggccgatttggaactggagagagcagccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctgtatcaataccaatcacggcagcagcatggtacctgtgggaagtgaagaaacaacgggccggagtattgtgggatgttccttcacccccacccatgggaaaggctgaactggaagatggagcctatagaattaagcaaaaagggattcttggatattcccagatcggagccggagtttacaaagaaggaacattccatacaatgtggcatgtcacacgtggcgctgttctaatgcataaaggaaagaggattgaaccatcatgggcggacgtcaagaaagacctaatatcatatggaggaggctggaagttagaaggagaatggaaggaaggagaagaagtccaggtattggcactggagcctggaaaaaatccaagagccgtccaaacgaaacctggtcttttcaaaaccaacgccggaacaataggtgctgtatctctggacttttctcctggaacgtcaggatctccaattatcgacaaaaaaggaaaagttgtgggtctttatggtaatggtgttgttacaaggagtggagcatatgtgagtgctatagcccagactgaaaaaagcattgaagacaacccagagatcgaagatgacattttccgaaagagaagactgaccatcatggacctccacccaggagcgggaaagacgaagagataccttccggccatagtcagagaagctataaaacggggtttgagaacattaatcttggcccccactagagttgtggcagctgaaatggaggaagcccttagaggacttccaataagataccagaccccagccatcagagctgagcacaccgggcgggagattgtggacctaatgtgtcatgccacatttaccatgaggctgctatcaccagttagagtgccaaactacaacctgattatcatggacgaagcccatttcacagacccagcaagtatagcagctagaggatacatctcaactcgagtggagatgggtgaggcagctgggatttttatgacagccactcccccgggaagcagagacccatttcctcagagcaatgcaccaatcatagatgaagaaagagaaatccctgaacgttcgtggaattccggacatgaatgggtcacggattttaaagggaagactgtttggttcgttccaagtataaaagcaggaaatgatatagcagcttgcctgaggaaaaatggaaagaaagtgatacaactcagtaggaagacctttgattctgagtatgtcaagactagaaccaatgattgggacttcgtggttacaactgacatttcagaaatgggtgccaatttcaaggctgagagggttatagaccccagacgctgcatgaaaccagtcatactaacagatggtgaagagcgggtgattctggcaggacctatgccagtgacccactctagtgcagcacaaagaagagggagaataggaagaaatccaaaaaatgagaatgaccagtacatatacatgggggaacctctggaaaatgatgaagactgtgcacactggaaagaagctaaaatgctcctagataacatcaacacgccagaaggaatcattcctagcatgttcgaaccagagcgtgaaaaggtggatgccattgatggcgaataccgcttgagaggagaagcaaggaaaacctttgtagacttaatgagaagaggagacctaccagtctggttggcctacagagtggcagctgaaggcatcaactacgcagacagaaggtggtgttttgatggagtcaagaacaaccaaatcctagaagaaaacgtggaagttgaaatctggacaaaagaaggggaaaggaagaaattgaaacccagatggttggatgctaggatctattctgacccactggcgctaaaagaatttaaggaatttgcagccggaagaaagtctctgaccctgaacctaatcacagaaatgggtaggctcccaaccttcatgactcagaaggcaagagacgcactggacaacttagcagtgctgcacacggctgaggcaggtggaagggcgtacaaccatgctctcagtgaactgccggagaccctggagacattgcttttactgacacttctggctacagtcacgggagggatctttttattcttgatgagcggaaggggcatagggaagatgaccctgggaatgtgctgcataatcacggctagcatcctcctatggtacgcacaaatacagccacactggatagcagcttcaataatactggagttttttctcatagttttgcttattccagaacctgaaaaacagagaacaccccaagacaaccaactgacctacgttgtcatagccatcctcacagtggtggccgcaaccatggcaaacgagatgggtttcctagaaaaaacgaagaaagatctcggattgggaagcattgcaacccagcaacccgagagcaacatcctggacatagatctacgtcctgcatcagcatggacgctgtatgccgtggccacaacatttgttacaccaatgttgagacatagcattgaaaattcctcagtgaatgtgtccctaacagctatagccaaccaagccacagtgttaatgggtctcgggaaaggatggccattgtcaaagatggacatcggagttccccttctcgccattggatgctactcacaagtcaaccccataactctcacagcagctcttttcttattggtagcacattatgccatcatagggccaggactccaagcaaaagcaaccagagaagctcagaaaagagcagcggcgggcatcatgaaaaacccaactgtcgatggaataacagtgattgacctagatccaataccttatgatccaaagtttgaaaagcagttgggacaagtaatgctcctagtcctctgcgtgactcaagtattgatgatgaggactacatgggctctgtgtgaggctttaaccttagctaccgggcccatctccacattgtgggaaggaaatccagggaggttttggaacactaccattgcggtgtcaatggctaacatttttagagggagttacttggccggagctggacttctcttttctattatgaagaacacaaccaacacaagaaggggaactggcaacataggagagacgcttggagagaaatggaaaagccgattgaacgcattgggaaaaagtgaattccagatctacaagaaaagtggaatccaggaagtggatagaaccttagcaaaagaaggcattaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaagaatgtaagagaagtcaaaggcctaacaaaaggaggaccaggacacgaagaacccatccccatgtcaacatatgggtggaatctagtgcgtcttcaaagtggagttgacgttttcttcatcccgccagaaaagtgtgacacattattgtgtgacataggggagtcatcaccaaatcccacagtggaagcaggacgaacactcagagtccttaacttagtagaaaattggttgaacaacaacactcaattttgcataaaggttctcaacccatatatgccctcagtcatagaaaaaatggaagcactacaaaggaaatatggaggagccttagtgaggaatccactctcacgaaactccacacatgagatgtactgggtatccaatgcttccgggaacatagtgtcatcagtgaacatgatttcaaggatgttgatcaacagatttacaatgagatacaagaaagccacttacgagccggatgttgacctcggaagcggaacccgtaacatcgggattgaaagtgagataccaaacctagatataattgggaaaagaatagaaaaaataaagcaagagcatgaaacatcatggcactatgaccaagaccacccatacaaaacgtgggcataccatggtagctatgaaacaaaacagactggatcagcatcatccatggtcaacggagtggtcaggctgctgacaaaaccttgggacgtcgtccccatggtgacacagatggcaatgacagacacgactccatttggacaacagcgcgtttttaaagagaaagtggacacgagaacccaagaaccgaaagaaggcacgaagaaactaatgaaaataacagcagagtggctttggaaagaattagggaagaaaaagacacccaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgaaacatgtgtgtacaacatgatgggaaaaagagagaagaagctaggggaattcggcaaggcaaaaggcagcagagccatatggtacatgtggcttggagcacgcttcttagagtttgaagccctaggattcttaaatgaagatcactggttctccagagagaactccctgagtggagtggaaggagaagggctgcacaagctaggttacattctaagagacgtgagcaagaaagagggaggagcaatgtatgccgatgacaccgcaggatgggatacaagaatcacactagaagacctaaaaaatgaagaaatggtaacaaaccacatggaaggagaacacaagaaactagccgaggccattttcaaactaacgtaccaaaacaaggtggtgcgtgtgcaaagaccaacaccaagaggcacagtaatggacatcatatcgagaagagaccaaagaggtagtggacaagttggcacctatggactcaatactttcaccaatatggaagcccaactaatcagacagatggagggagaaggagtctttaaaagcattcagcacctaacaatcacagaagaaatcgctgtgcaaaactggttagcaagagtggggcgcgaaaggttatcaagaatggccatcagtggagatgattgtgttgtgaaacctttagatgacaggttcgcaagcgctttaacagctctaaatgacatgggaaagattaggaaagacatacaacaatgggaaccttcaagaggatggaatgattggacacaagtgcccttctgttcacaccatttccatgagttaatcatgaaagacggtcgcgtactcgttgttccatgtagaaaccaagatgaactgattggcagagcccgaatctcccaaggagcagggtggtctttgcgggagacggcctgtttggggaagtcttacgcccaaatgtggagcttgatgtacttccacagacgcgacctcaggctggcggcaaatgctatttgctcggcagtaccatcacattgggttccaacaagtcgaacaacctggtccatacatgctaaacatgaatggatgacaacggaagacatgctgacagtctggaacagggtgtggattcaagaaaacccatggatggaagacaaaactccagtggaatcatgggaggaaatcccatacttggggaaaagagaagaccaatggtgcggctcattgattgggttaacaagcagggccacctgggcaaagaacatccaagcagcaataaatcaagttagatcccttataggcaatgaagaatacacagattacatgccatccatgaaaagattcagaagagaagaggaagaagcaggagttctgtggtagaaagcaaaactaacatgaaacaaggctagaagtcaggtcggattaagccatagtacggaaaaaactatgctacctgtgagccccgtccaaggacgttaaaagaagtcaggccatcataaatgccatagcttgagtaaactatgcagcctgtagctccacctgagaaggtgtaaaaaatccgggaggccacaaaccatggaagctgtacgcatggcgtagtggactagcggttagaggagacccctcccttacaaatcgcagcaacaatgggggcccaaggcgagatgaagctgtagtctcgctggaaggactagaggttagaggagacccccccgaaacaaaaaacagcatattgacgctgggaaagaccagagatcctgctgtctcctcagcatcattccaggcacagaacgccagaaaatggaatggtgctgttgaatcaacaggttct

SEQ ID NO: 225 - DNA, 10707 bp, Dengue Virus
agttgttagtctacgtggaccgacaagaacagtttcgactcggaagcttgcttaacgtagtgctgacagttttttattagagagcagatctctgatgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaaccaacggaaaaagacatcgctctgtctcatgatgatattgccagcagcacttgctttccacttgacttcacgagatggagagccgcgcatgattgtggggaagaatgaaagaggtaaatccctactttttaagacagcctctggaatcaacatgtgcacactcatagccatggatttgggagagatgtgtgatgacacggtcacttacaaatgcccccacattaccgaagtggaacctgaagacattgactgctggtgcaaccttacatcaacatgggtgacttatggaacgtgcaatcaagctggagagcatagacgcgacaagagatcagtggcgttagctccccatgtcggcatgggactggacacacgcacccaaacctggatgtcggctgaaggagcttggagacaagtcgagaaggtagagacatgggcccttaggcacccagggttcaccatactagccctatttctcgcccattacataggcacttccctgacccagaaggtggttattttcatattattaatgctggtcaccccatccatgacaatgagatgtgtgggagtaggaaacagagattttgtggaagggctatcaggagctacgtgggttgacgtggtgctcgagcacggggggtgtgtgactaccatggctaagaacaagcccacgctggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggttgggggaacggttgtggtttgtttggcaaaggaagcttggtaacatgtgcgaaatttcaatgcctggaaccaatagagggaaaagtggtgcaatatgagaacctcaaatacaccgtcatcattacagtgcacacaggagaccaacaccaggtgggaaatgaaacgcaaggagtcacggctgagataacacctcaggcatcaaccactgaagccatcttgcctgaatatggaacccttgggctagaatgctcaccacggacaggtttggatttcaatgaaatgatcttactaacaatgaagaacaaagcatggatggtacatagacaatggttctttgacctacctctaccatgggcatcaggagctacaacagaaacaccaacctggaacaggaaggagcttcttgtgacattcaaaaacgcacatgcgaaaaaacaagaagtagttgtccttggatcgcaagagggagcaatgcataccgcactgacaggagctacagaaatccaaaactcaggaggcacaagcattttcgcggggcacttaaaatgtagacttaagatggacaaattggaactcaaggggatgagctatgcaatgtgcacgaatacctttgtgttgaagaaagaagtctcagaaacgcagcacgggacaatactcattaaggttgagtacaaaggggaagatgcaccttgcaagattcccttttccacagaggatggacaagggaaagctcataatggcagactgatcacagccaaccctgtggtgactaagaaggaggagcctgtcaatattgaggctgaacctccttttggggaaagcaatatagtaattggaattggagacaacgccttgaaaatcaactggtacaagaaggggagctcgattgggaagatgttcgaggccactgaaaggggtgcaaggcgcatggccatcttgggagacacagcttgggactttggatcagtgggtggtgttctgaactcattaggcaaaatggtgcaccaaatatttggaagtgcttatacagccctgttcagtggagtctcttgggtgatgaaaattggaataggtgtcctcttgacttggatagggttgaattcaaaaaacacatccatgtcattttcatgcattgcgataggaatcattacactctatctgggagctgtggtacaagctgacatggggtgtgtcataaactggaagggcaaagaactcaaatgtggaagcggaattttcgtcaccaatgaggtccatacctggacagagcaatacaaattccaagcagactccccaaaaagattggcaacagccattgcaggcgcctgggagaatggagtgtgtggaattaggtcaacaaccagaatggagaatctcttgtggaagcaaatagccaatgaactgaactacatattatgggaaaacaatatcaaattaacggtagttgtgggcgatacacttggggtcttagagcaagggaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtctacacccaactatgtgaccataggctaatgtcggcagctgtcaaggatgagagggccgtgcatgccgacatgggctactggatagaaagccaaaagaatggaagttggaagctagaaaaagcatccctcatagaggtaaaaacctgcacatggccaaaatcacacactctctggactaatggtgtgctagagagtgacatgatcatcccaaagagtctagctggtcctatctcacaacacaactacaggcccgggtaccacacccaaacggcaggaccctggcacttaggaaaattggagctggacttcaactactgtgaaggaacaacagttgtcatcacagaaagctgtgggacaagaggcccatcattgagaacaacaacagtgtcagggaagttgatacacgaatggtgttgccgctcgtgcacacttccccccctgcgatacatgggagaagacggctgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgttgagaggaaaatttgggaagaaacacatgattgcaggggttttctttacgtttgtgctccttctctcagggcaaataacatggagagacatggcgcacacactaataatgatcgggtccaacgcctctgacaggatgggaatgggcgtcacctacctagctctaattgcaacatttaaaatccagccattcttggctttgggatttttcctaagaaagctgacatctagagaaaatttattgttaggagttgggttggccatggcaacaacgttacaactgccagaggacattgaacaaatggcaaatggagtcgctctggggctcatggctcttaaactgataacacaatttgaaacataccaattgtggacggcattagtctccttaacgtgttcaaacacaatttttacgttgactgttgcctggagaacagccactctgattttggccggagtttcgcttttaccagtgtgccagtcttcaagcatgaggaaaacagattggctcccaatgacagtggcagctatgggagttccaccccttccactttttatttttagcttgaaagacacactcaaaaggagaagctggccactgaatgaaggggtgatggctgttgggcttgtgagcattctggccagttctctccttagaaatgatgtgcccatggctggaccattagtggccgggggcttgctgatagcgtgctacgtcataactggcacgtcagcggacctcactgtagaaaaagccccagatgtaacatgggaggaagaggctgagcagacaggagtgtcccacaacttaatgatcacagttgatgatgatggaacaatgagaataaaagatgatgagactgagaacatcctaacagtgcttttaaaaacagcattactaatagtatcaggcatttttccatactccatacccgcaacattgttggtctggcacacttggcaaaaacaaacccaaagatccggcgttttatgggacgtacccagccccccagagacacagaaagcagaactggaagaaggggtttataggatcaaacagcaaggaatttttgggaaaacccaagtaggggttggagtacagaaagaaggagtcttccacaccatgtggcacgtcacaagaggggcagtgttgacacataatgggaaaagactggaaccaaactgggctagtgtgaaaaaagatctgatttcatatggaggaggatggagactgagcgcacaatggcaaaagggggaggaggtgcaggttattgccgtagagccagggaagaacccaaagaactttcaaaccacgccaggcactttccagactactacaggggaaataggagcaattgcactggatttcaagcctggaacttcaggatctcctatcataaatagagagggaaaggtagtgggactgtatggcaatggagtggttacaaagaatggtggctatgtcagcggaatagcgcaaacaaatgcagaaccagatggaccgacaccagagttggaagaagagatgttcaaaaagcgaaacctgaccataatggatcttcatcctgggtcaggaaagacacggaaataccttccagctattgtcagagaggcaatcaagagacgtttaagaaccttaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtttgctgtcaccagttagggttccaaattacaacttgataataatggatgaggcccatttcacagacccagccagtatagcggctagagggtacatatcaactcgtgttggaatgggagaggcagccgcaatcttcatgacagcaacaccccctggaacagctgatgcctttcctcagagcaacgctccaattcaagatgaagaaagggacataccagaacgctcatggaattcaggcaatgaatggattaccgacttcgctgggaaaacggtgtggtttgtccctagcattaaagccggaaatgacatagcaaactgcttgcgaaaaaacgggaaaaaagtcattcaacttagtaggaagacttttgacacagaatatcagaagactaaactgaatgattgggactttgtggtgacaactgacatttcagaaatgggggccaatttcaaagcagatagagtgatcgacccaagaagatgtctcaaaccagtgatcttgacagatggaccagagcgggtgatcctggccggaccaatgccagtcaccgcggcgagtgctgcgcaaaggagagggagagttggcaggaacccacaaaaagagaatgaccagtacatattcacgggccagcctctcaacaatgatgaagaccatgctcactggacagaagcaaaaatgctgctggacaacatcaacacaccagaagggattataccagctctctttgaaccagaaagggagaagtcagccgccatagacggtgagtatcgcctgaagggtgagtccaggaagactttcgtggaactcatgaggaggggtgaccttccagtttggttagcccataaagtagcatcagaaggaatcaaatacacagatagaaaatggtgctttgatgggcaacgcaataatcaaattttagaggagaacatggatgtggaaatttggacaaaggaaggagaaaagaaaaaattgagacctaggtggcttgatgcccgcacttattcagatccattggcactcaaggaattcaaggactttgcggctggcagaaagtcaatcgcccttgatcttgtgacagaaataggaagagtgccttcacatctagcccacagaacaagaaacgctctggacaatctggtgatgctgcatacgtcagaagatggcggtagggcttacaggcatgcggtggaggaactaccagaaacaatggaaacactcctactcttgggactaatgatcttgttgacaggtggagcaatgcttttcttgatatcaggtaaagggattggaaagacttcaataggactcatttgtgtaatcgcttccagcggcatgttgtggatggccgaagttccactccaatggatcgcgtcggctatagtcctggagttttttatgatggtgttgctcataccagaaccagaaaagcagagaaccccccaagacaaccaactcgcatatgtcgtgataggcatacttacattggctgcaacaatagcagccaatgaaatgggactgctggaaaccacaaagagagacttaggaatgtctaaggagccaggtgttgtttctccaaccagctatttggatgtggacttgcacccagcatcagcctggacattgtacgccgtggccactacagtaataacaccaatgttaagacataccatagagaattctacagcaaatgtgtccctggcagctatagccaaccaggcagtggtcctgatgggtttggacaaaggatggccaatatcaaaaatggacttaggcgtgccactactggcactgggttgctattcacaagtgaacccactgactctaactgcggcagtacttttgctaatcacacattatgctatcataggtccaggattgcaagcaaaagccacccgtgaagctcagaaaaggacagctgctggaataatgaagaatccaacagtggatgggataatgacaatagacctagattctgtaatatttgattcaaaatttgaaaaacaactgggacaggttatgctcctggttttgtgcgcagtccaactcttgctaatgagaacatcatgggccttgtgtgaagctttaactctagctacaggaccaataacaacactctgggaaggatcacctggtaagttctggaacaccacgatagctgtttccatggcgaacatttttagagggagctatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatctggaatcactgaagtggatagaacagaagccaaagaagggttgaaaagaggagagacaacacatcatgccgtgtcccgaggtagcgcaaaacttcaatggtttgtggaaagaaacatggtcgttcccgaaggaagagtcatagacttgggctgtggaagaggaggctggtcatattactgtgcaggactgaaaaaagtcacagaagtgcgaggatacacaaaaggcggtccaggacacgaagaaccagtacctatgtctacatatggatggaacatagttaagttaatgagcggaaaggatgtgttctatctcccacctgaaaagtgtgataccctgttgtgtgacattggagaatcttcaccaagcccaacagtggaagagagcagaactataagagttttgaagatggttgaaccatggctaaaaaacaaccagttttgcattaaagttttgaacccttacatgccaactgtgattgagcacctagaaagactacaaaggaaacatggaggaatgcttgtgagaaatccactttcacgaaactccacgcacgaaatgtactggatatctaatggcacaggtaacattgtctcttcagtcaacatggtgtctagattgctactgaacaggttcacgatgacacacaggagacccaccatagagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcctatgaagtcaaagccacaggctcagcctcctccatgataaatggagtcgtgaaactcctcaccaaaccatgggatgtggtgcccatggtgacacagatggcaatgacagacacaactccatttggccagcagagagtctttaaagagaaagtggacaccaggacgcccaggcccatgccagggacaagaaaggctatggagatcacagcggagtggctctggagaaccctgggaaggaacaaaagacccagattatgcacaagggaagagtttacaaaaaaggtcagaactaacgcagccatgggcgccgttttcacagaggagaaccaatgggacagtgcgaaagctgctgttgaggatgaagaattttggaaacttgtggacagagaacgtgaactccacaaattgggcaaatgtggaagctgcgtttataacatgatgggcaagagagagaaaaaacttggagagtttggcaaagcaaaaggcagtagagctatatggtacatgtggttgggagccaggtaccttgagttcgaagcccttggattcttaaatgaagaccactggttctcgcgtgaaaactcttacagtggagtagaaggagaaggactgcacaagctaggctacatattaagggacatttccaagatacccggaggagccatgtatgctgatgacacagctggttgggacacaagaataacagaagatgacctgcacaatgaggaaaagatcatacagcaaatggaccctgaacacaggcagttagcgaacgctatattcaagctcacataccaaaacaaagtggtcaaagttcaacgaccgactccaacgggcacggtaatggatattatatctaggaaagaccaaaggggcagtggacaactgggaacttatggcctgaatacattcaccaacatggaagcccagttagtcagacaaatggaaggagaaggtgtgctgacaaaggcagacctcgagaaccctcatctgctagagaagaaaatcacacaatggttggaaaccaaaggagtggagaggttaaaaagaatggccattagcggggatgattgcgtggtgaaaccaatcgatgacaggttcgctaatgccctgcttgctttgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaactgcatgtctggggaaagcctacgcccaaatgtggagtctcatgtattttcacagaagagatctcagattagcatccaacgccatatgttcagcagtaccagtccactgggttcccacaagtagaacgacatggtctattcatgctcaccatcagtggatgactacagaagacatgcttactgtttggaacagggtgtggatagaggaaaatccatggatggaagacaaaactccagttacaacttgggaaaatgttccatatctaggaaagagagaagaccaatggtgtggatcacttattggtctcacttccagagcaacctgggcccagaacatacccacagcaattcaacaggtgagaagccttataggcaatgaagagttcctggactacatgccttcaatgaagagattcaggaaggaagaggagtcggagggagccatttggtaaacgtaggaagtggaaaagaggctaactgtcaggccaccttaagccacagtacggaagaagctgtgctgcctgtgagccccgtccaaggacgttaaaagaagaagtcaggccccaaagccacggtttgagcaaaccgtgctgcctgtagctccgtcgtggggacgtaaaacctgggaggctgcaaactgtggaagctgtacgcacggtgtagcagactagcggttagaggagacccctcccatgacacaacgcagcagcggggcccgagcactgagggaagctgtacctccttgcaaaggactagaggttagaggagaccccccgcaaataaaaacagcatattgacgctgggagagaccagagatcctgctgtctcctcagcatcattccaggcacagaacgccagaaaatggaatggtgctgttgaatcaacaggttct

SEQ ID NO: 226 - DNA, 10649 bp, Dengue Virus
agttgttagtctgtgtggaccgacaaggacagttccaaatcggaagcttgcttaacacagttctaacagtttgtttgaatagagagcagatctctggaaaaatgaaccaacgaaaaaaggtggttagaccacctttcaatatgctgaaacgcgagagaaaccgcgtatcaacccctcaagggttggtgaagagattctcaaccggacttttttctgggaaaggacccttacggatggtgctagcattcatcacgtttttgcgagtcctttccatcccaccaacagcagggattctgaagagatggggacagttgaagaaaaataaggccatcaagatactgattggattcaggaaggagataggccgcatgctgaacatcttgaacgggagaaaaaggtcaacgataacattgctgtgcttgattcccaccgtaatggcgttttccctcagcacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtataaatgccccctactggtcaataccgaacctgaagacattgattgctggtgcaacctcacgtctacctgggtcatgtatgggacatgcacccagagcggagaacggagacgagagaagcgctcagtagctttaacaccacattcaggaatgggattggaaacaagagctgagacatggatgtcatcggaaggggcttggaagcatgctcagagagtagagagctggatactcagaaacccaggattcgcgctcttggcaggatttatggcttatatgattgggcaaacaggaatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgactaagacaacagccaaggaagtggctctgttaagaacctattgcattgaagcctcaatatcaaacataactacggcaacaagatgtccaacgcaaggagagccttatctgaaagaggaacaggaccaacagtacatttgccggagagatgtggtagacagagggtggggcaatggctgtggcttgtttggaaaaggaggagttgtgacatgtgcgaagttttcatgttcggggaagataacaggcaatttggtccaaattgagaaccttgaatacacagtggttgtaacagtccacaatggagacacccatgcagtaggaaatgacacatccaatcatggagttacagccatgataactcccaggtcaccatcggtggaagtcaaattgccggactatggagaactaacactcgattgtgaacccaggtctggaattgactttaatgagatgattctgatgaaaatgaaaaagaaaacatggctcgtgcataagcaatggtttttggatctgcctcttccatggacagcaggagcagacacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatcttaagtgcaaagtccgtatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgtatcatctcatccacccctttggctgagaataccaacagtgtaaccaacatagaattagaacccccctttggggacagctacatagtgataggtgttggaaacagcgcattaacactccattggttcaggaaagggagttccattggcaagatgtttgagtccacatacagaggtgcaaaacgaatggccattctaggtgaaacagcttgggattttggttccgttggtggactgttcacatcattgggaaaggctgtgcaccaggtttttggaagtgtgtatacaaccatgtttggaggagtctcatggatgattagaatcctaattgggttcttagtgttgtggattggcacgaactcgaggaacacttcaatggctatgacgtgcatagctgttggaggaatcactctgtttctgggcttcacagttcaagcagacatgggttgtgtggcgtcatggagtgggaaagaattgaagtgtggaagcggaatttttgtggttgacaacgtgcacacttggacagaacagtacaaatttcaaccagagtccccagcgagactagcgtctgcaatattaaatgcccacaaagatggggtctgtggaattagatcaaccacgaggctggaaaatgtcatgtggaagcaaataaccaacgagctaaactatgttctctgggaaggaggacatgacctcactgtagtggctggggatgtgaagggggtgttgaccaaaggcaagagagcactcacacccccagtgagtgatctgaaatattcatggaagacatggggaaaagcaaaaatcttcaccccagaagcaagaaatagcacatttttaatagacggaccagacacctctgaatgccccaatgaacgaagagcatggaactctcttgaggtggaagactatggatttggcatgttcacgaccaacatatggatgaaattccgagaaggaagttcagaagtgtgtgaccacaggttaatgtcagctgcaattaaagatcagaaagctgtgcatgctgacatgggttattggatagagagctcaaaaaaccagacctggcagatagagaaagcatctcttattgaagtgaaaacatgtctgtggcccaagacccacacactgtggagcaatggagtgctggaaagccagatgctcattccaaaatcatatgcgggccctttttcacagcacaattaccgccagggctatgccacgcaaaccgtgggcccatggcacttaggcaaattagagatagactttggagaatgccccggaacaacagtcacaattcaggaggattgtgaccatagaggcccatctttgaggaccaccactgcatctggaaaactagtcacgcaatggtgctgccgctcctgcacgatgcctcccttaaggttcttgggagaagatgggtgctggtatgggatggagattaggcccttgagtgaaaaagaagagaacatggtcaaatcacaggtgacggccggacagggcacatcagaaactttttctatgggtctgttgtgcctgaccttgtttgtggaagaatgcttgaggagaagagtcactaggaaacacatgatattagttgtggtgatcactctttgtgctatcatcctgggaggcctcacatggatggacttactacgagccctcatcatgttgggggacactatgtctggtagaataggaggacagatccacctagccatcatggcagtgttcaagatgtcaccaggatacgtgctgggtgtgtttttaaggaaactcacttcaagagagacagcactaatggtaataggaatggccatgacaacggtgctttcaattccacatgaccttatggaactcattgatggaatatcactgggactaattttgctaaaaatagtaacacagtttgacaacacccaagtgggaaccttagctctttccttgactttcataagatcaacaatgccattggtcatggcttggaggaccattatggctgtgttgtttgtggtcacactcattcctttgtgcaggacaagctgtcttcaaaaacagtctcattgggtagaaataacagcactcatcctaggagcccaagctctgccagtgtacctaatgactcttatgaaaggagcctcaagaagatcttggcctcttaacgagggcataatggctgtgggtttggttagtctcttaggaagcgctcttttaaagaatgatgtccctttagctggcccaatggtggcaggaggcttacttctggcggcttacgtgatgagtggtagctcagcagatctgtcactagagaaggccgccaacgtgcagtgggatgaaatggcagacataacaggctcaagcccaatcgtagaagtgaagcaggatgaagatggctctttctccatacgggacgtcgaggaaaccaatatgataacccttttggtgaaactggcactgataacagtgtcaggtctctaccccttggcaattccagtcacaatgaccttatggtacatgtggcaagtgaaaacacaaagatcaggagccctgtgggacgtcccctcacccgctgccactaaaaaagccgcactgtctgaaggagtgtacaggatcatgcaaagagggttattcgggaaaactcaggttggagtagggatacacatggaaggtgtatttcacacaatgtggcatgtaacaagaggatcagtgatctgccacgagactgggagattggagccatcttgggctgacgtcaggaatgacatgatatcatacggtgggggatggaggcttggagacaaatgggacaaagaagaagacgttcaggtcctcgccatagaaccaggaaaaaatcctaaacatgtccaaacgaaacctggccttttcaagaccctaactggagaaattggagcagtaacattagatttcaaacccggaacgtctggttctcccatcatcaacaggaaaggaaaagtcatcggactctatggaaatggagtagttaccaaatcaggtgattacgtcagtgccataacgcaagccgaaagaattggagagccagattatgaagtggatgaggacatttttcgaaagaaaagattaactataatggacttacaccccggagctggaaagacaaaaagaattcttccatcaatagtgagagaagccttaaaaaggaggctacgaactttgattttagctcccacgagagtggtggcggccgagatggaagaggccctacgtggactgccaatccgttatcagaccccagctgtgaaatcagaacacacaggaagagagattgtagacctcatgtgtcatgcaaccttcacaacaagacttttgtcatcaaccagggttccaaattacaaccttatagtgatggatgaagcacatttcaccgatccttctagtgtcgcggctagaggatacatctcgaccagggtggaaatgggagaggcagcagccatcttcatgaccgcaacccctcccggagcgacagatccctttccccagagcaacagcccaatagaagacatcgagagggaaattccggaaaggtcatggaacacagggttcgactggataacagactaccaagggaaaactgtgtggtttgttcccagcataaaagctggaaatgacattgcaaattgtttgagaaagtcgggaaagaaagttatccagttgagtaggaaaacctttgatacagagtatccaaaaacgaaactcacggactgggactttgtggtcactacagacatatctgaaatgggggccaattttagagccgggagagtgatagaccctagaagatgcctcaagccagttatcctaccagatgggccagagagagtcattttagcaggtcctattccagtgactccagcaagcgctgctcagagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagccattgatggagagtttcgcctcagaggggaacaaaggaagacttttgtggaattaatgaggagaggagaccttccggtgtggctgagctataaggtagcttctgctggcatttcttacgaagatcgggaatggtgcttcacaggggaaagaaataaccaaattttagaagaaaacatggaggttgaaatttggactagagagggagaaaagaaaaagctaaggccaagatggttagatgcacgtgtatacgctgaccccatggctttgaaggatttcaaggagtttgccagtggaaggaagagtataactctcgacatcctaacagagattgccagtttgccaacttacctttcctctagggccaagctcgcccttgataacatagtcatgctccacacaacagaaagaggagggagggcctatcaacacgccctgaacgaacttccggagtcactggaaacactcatgcttgtagctttactaggtgctatgacagcaggcatcttcctgtttttcatgcaagggaaaggaatagggaaattgtcaatgggtttgataaccattgcggtggctagtggcttgctctgggtagcagaaattcaaccccagtggatagcggcctcaatcatactagagttttttctcatggtactgttgataccggaaccagaaaaacaaaggaccccacaagacaatcaattgatctacgtcatattgaccattctcaccatcattggtctaatagcagccaacgagatggggctgattgaaaaaacaaaaacggattttgggttttaccaggtaaaaacagaaaccaccatcctcgatgtggacttgagaccagcttcagcatggacgctctatgcagtagccaccacaattctgactcccatgctgagacacaccatagaaaacacgtcggccaacctatctctagcagccattgccaaccaggcagccgtcctaatggggcttggaaaaggatggccgctccacagaatggacctcggtgtgccgctgttagcaatgggatgctattctcaagtgaacccaacaaccttgacagcatccttagtcatgcttttagtccattatgcaataataggcccaggattgcaggcaaaagccacaagagaggcccagaaaaggacagctgctgggatcatgaaaaatcccacagtggacgggataacagtaatagatctagaaccaatatcctatgacccaaaatttgaaaagcaattagggcaggtcatgctactagtcttgtgtgctggacaactactcttgatgagaacaacatgggctttctgtgaagtcttgactttggccacaggaccaatcttgaccttgtgggagggcaacccgggaaggttttggaacacgaccatagccgtatccaccgccaacattttcaggggaagttacttggcgggagctggactggctttttcactcataaagaatgcacaaacccctaggaggggaactgggaccacaggagagacactgggagagaagtggaagagacagctaaactcattagacagaaaagagtttgaagagtataaaagaagtggaatactagaagtggacaggactgaagccaagtctgccctgaaagatgggtctaaaatcaagcatgcagtatcaagagggtccagtaagatcagatggattgttgagagagggatggtaaagccaaaagggaaagttgtagatcttggctgtgggagaggaggatggtcttattacatggcgacactcaagaacgtgactgaagtgaaagggtatacaaaaggaggtccaggacatgaagaaccgattcccatggctacttatggttggaatttggtcaaactccattcaggggttgacgtgttctacaaacccacagagcaagtggacaccctgctctgtgatattggggagtcatcttctaatccaacaatagaggaaggaagaacattaagagttttgaagatggtggagccatggctctcttcaaaacctgaattctgcatcaaagtccttaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacttatgagaaggacgtagatcttggggcaggaacgagaagtgtctccactgaaacagaaaaaccagacatgacaatcattgggagaaggcttcagcgattgcaagaagagcacaaagaaacctggcattatgatcaggaaaacccatacagaacctgggcgtatcatggaagctatgaagctccttcgacaggctctgcatcctccatggtgaacggggtggtaaaactgctaacaaaaccctgggatgtgattccaatggtgactcagttagccatgacagatacaaccccttttgggcaacaaagagtgttcaaagagaaggtggataccagaacaccacaaccaaaacccggtacacgaatggttatgaccacgacagccaattggctgtgggccctccttggaaagaagaaaaatcccagactgtgcacaagggaagagttcatctcaaaagttagatcaaacgcagccataggcgcagtctttcaggaagaacagggatggacatcagccagtgaagctgtgaatgacagccggttttgggaactggttgacaaagaaagggccctacaccaggaagggaaatgtgaatcgtgtgtctataacatgatgggaaaacgtgagaaaaagttaggagagtttggcagagccaagggaagccgagcaatctggtacatgtggctgggagcgcggtttctggaatttgaagccctgggttttttgaatgaagatcactggtttggcagagaaaattcatggagtggagtggaaggggaaggtctgcacagattgggatatatcctggaggagatagacaagaaggatggagacctaatgtatgctgatgacacagcaggctgggacacaagaatcactgaggatgaccttcaaaatgaggaactgatcacggaacagatggctccccaccacaagatcctagccaaagccattttcaaactaacctatcaaaacaaagtggtgaaagtcctcagacccacaccgcggggagcggtgatggatatcatatccaggaaagaccaaagaggtagtggacaagttggaacatatggtttgaacacattcaccaacatggaagttcaactcatccgccaaatggaagctgaaggagtcatcacacaagatgacatgcagaacccaaaagggttgaaagaaagagttgagaaatggctgaaagagtgtggtgtcgacaggttaaagaggatggcaatcagtggagacgattgcgtggtgaagcccctagatgagaggtttggcacttccctcctcttcttgaacgacatgggaaaggtgaggaaagacattccgcagtgggaaccatctaagggatggaaaaactggcaagaggttcctttttgctcccaccactttcacaagatctttatgaaggatggccgctcactagttgttccatgtagaaaccaggatgaactgatagggagagccagaatctcgcagggagctggatggagcttaagagaaacagcctgcctgggcaaagcttacgcccagatgtggtcgcttatgtacttccacagaagggatctgcgtttagcctccatggccatatgctcagcagttccaacggaatggtttccaacaagcagaacaacatggtcaatccacgctcatcaccagtggatgaccactgaagatatgctcaaagtgtggaacagagtgtggatagaagacaaccctaatatgactgacaagactccagtccattcgtgggaagatataccttacctagggaaaagagaggatttgtggtgtggatccctgattggactttcttccagagccacctgggcgaagaacattcatacggccataacccaggtcaggaacctgatcggaaaagaggaatacgtggattacatgccagtaatgaaaagatacagtgctccttcagagagtgaaggagttctgtaattaccaacaacaaacaccaaaggctattgaagtcaggccacttgtgccacggtttgagcaaaccgtgctgcctgtagctccgccaataatgggaggcgtaataatccccagggaggccatgcgccacggaagctgtacgcgtggcatattggactagcggttagaggagacccctcccatcactgataaaacgcagcaaaagggggcccgaagccaggaggaagctgtactcctggtggaaggactagaggttagaggagacccccccaacacaaaaacagcatattgacgctgggaaagaccagagatcctgctgtctctgcaacatcaatccaggcacagagcgccgcaagatggattggtgttgttgatccaacaggttct

SEQ ID NO: 227 - DNA, 2049 bp, Artificial Sequence
  Synthetic Polynucleotide
atggatgctatgaaaagaggcctgtgttgtgtgttgctgttgtgcggagctgtgtttgtgtcacctttccacctgactacccgcaatggtgagccccatatgattgtgtcgcgccaggagaaggggaagtccctcctgttcaaaactgaaaacggcgtgaacatgtgtaccctgatggccatggaccttggagaactgtgcgaggacaccatcacctacaattgtccgctcctgcgccaaaacgaaccagaagatatcgactgctggtgcaattccacttcaacctgggttacctacggaacttgcaccgccacgggagaacacagaagagaaaagcgctcggtggcgctggtgcctcatgtcggaatgggactggagactcggacggagacttggatgtcctcggagggagcatggaaacatgcccaacggatcgaaacttgggtgctgaggcaccctggattcaccatcatggcagcgatcctcgcctacactataggtactacctactttcaaagggtgctgatcttcattctcctcaccgcagtggccccttcaatgaccatgaggtgcattgggatctcgaaccgggacttcgtcgaaggagtgtccggaggtagctgggtcgacatcgtcctggaacacggaagctgcgtgactactatggcgaagaacaagccaaccttggacttcgagcttatcaagaccgaggcgaagcacccggccactctgagaaagtactgcatcgaggctaagctcaccaacacgaccactgcctcgcgatgcccaactcagggagaaccgtcactgaacgaagaacaggataaacgctttgtgtgcaagcatagcatggtggatagaggctggggaaacggctgtggactcttcggaaagggtggaattgtgacgtgcgcaatgttcacttgcaagaagaatatggaagggaagatcgtccagccggagaacctggaatacactatcgtgatcaccccgcactcaggcgaggagaacgcagtgggcaacgataccgggaagcacgggaaggaaatcaaggtgaccccgcagtcgtccattaccgaggccgaactcaccggatacggcactgtgactatggaatgctcgccacggaccgggctggatttcaatgagatggtgctcttgcaaatggagaacaaagcctggctggtccaccgccagtggttcctcgacctcccccttccgtggctgccgggagctgacacccaaggatccaactggatccaaaaagaaacccttgtcacgtttaagaatccacatgccaaaaagcaggacgtggtcgtgctcggaagccaggaaggagccatgcacactgcgctgactggagcaaccgaaattcaaatgtcgagcggcaacctcctcttcactggacatctgaagtgccggctgcgcatggacaaactgcaacttaagggcatgtcatactcgatgtgtaccggcaaattcaaggtggtgaaggagatcgcggagactcagcacgggaccatcgtcatccgggtccagtatgagggtgatggttccccctgcaagatccctttcgaaatcatggatctggagaaacgtcacgtgctgggccggctgatcactgtgaatccgatcgttacggagaaagacagcccggtgaacatcgaagctgaaccgccgtttggggatagctacattatcatcggcgtggaaccaggccagctcaagttgtcgtggttcaagaaaggatccagcatcggacagatgttcgaaaccactatgcgcggagccaaacgcatggctatcctgggggacacggcctgggacttcgggtcgctgggtggtgtgttcacctccattggaaaggcgctccatcaggtgtttggtgcgatctacggcgccgcattctccggagtgtcatggaccatgaagatcctcatcggagtcgtcatcacctggatcggcatgaattctcggtccacttccttgagcgtcagcctggtgctggtcggagttgtgactctgtaccttggagtgatggtccaggcc

SEQ ID NO: 228 - DNA, 1749 bp, Artificial Sequence
  Synthetic Polynucleotide
atggatgctatgaaaagaggcctgtgttgtgtgttgctgttgtgcggagctgtgtttgtgtcacctttccacctgactacccgcaatggtgagccccatatgattgtgtcgcgccaggagaaggggaagtccctcctgttcaaaactgaaaacggcgtgaacatgtgtaccctgatggccatggaccttggagaactgtgcgaggacaccatcacctacaattgtccgctcctgcgccaaaacgaaccagaagatatcgactgctggtgcaattccacttcaacctgggttacctacggaacttgcaccgccacgggagaacacagaagagaaaagcgctcggtggcgctggtgcctcatgtcggaatgggactggagactcggacggagacttggatgtcctcggagggagcatggaaacatgcccaacggatcgaaacttgggtgctgaggcaccctggattcaccatcatggcagcgatcctcgcctacactataggtactacctactttcaaagggtgctgatcttcattctcctcaccgcagtggccccttcaatgaccatgaggtgcattgggatctcgaaccgggacttcgtcgaaggagtgtccggaggtagctgggtcgacatcgtcctggaacacggaagctgcgtgactactatggcgaagaacaagccaaccttggacttcgagcttatcaagaccgaggcgaagcacccggccactctgagaaagtactgcatcgaggctaagctcaccaacacgaccactgcctcgcgatgcccaactcagggagaaccgtcactgaacgaagaacaggataaacgctttgtgtgcaagcatagcatggtggatagaggctggggaaacggctgtggactcttcggaaagggtggaattgtgacgtgcgcaatgttcacttgcaagaagaatatggaagggaagatcgtccagccggagaacctggaatacactatcgtgatcaccccgcactcaggcgaggagaacgcagtgggcaacgataccgggaagcacgggaaggaaatcaaggtgaccccgcagtcgtccattaccgaggccgaactcaccggatacggcactgtgactatggaatgctcgccacggaccgggctggatttcaatgagatggtgctcttgcaaatggagaacaaagcctggctggtccaccgccagtggttcctcgacctcccccttccgtggctgccgggagctgacacccaaggatccaactggatccaaaaagaaacccttgtcacgtttaagaatccacatgccaaaaagcaggacgtggtcgtgctcggaagccaggaaggagccatgcacactgcgctgactggagcaaccgaaattcaaatgtcgagcggcaacctcctcttcactggacatctgaagtgccggctgcgcatggacaaactgcaacttaagggcatgtcatactcgatgtgtaccggcaaattcaaggtggtgaaggagatcgcggagactcagcacgggaccatcgtcatccgggtccagtatgagggtgatggttccccctgcaagatccctttcgaaatcatggatctggagaaacgtcacgtgctgggccggctgatcactgtgaatccgatcgttacggagaaagacagcccggtgaacatcgaagctgaaccgccgtttggggatagctacattatcatcggcgtggaaccaggccagctcaagttgtcgtggttcaagaaagga

SEQ ID NO: 229 - DNA, 2544 bp, Artificial Sequence
  Synthetic Polynucleotide
atggatgctatgaaaagaggcctgtgttgtgtgttgctgttgtgcggagctgtgtttgtgtcacctttccacctgactacccgcaatggtgagccccatatgattgtgtcgcgccaggagaaggggaagtccctcctgttcaaaactgaaaacggcgtgaacatgtgtaccctgatggccatggaccttggagaactgtgcgaggacaccatcacctacaattgtccgctcctgcgccaaaacgaaccagaagatatcgactgctggtgcaattccacttcaacctgggttacctacggaacttgcaccgccacgggagaacacagaagagaaaagcgctcggtggcgctggtgcctcatgtcggaatgggactggagactcggacggagacttggatgtcctcggagggagcatggaaacatgcccaacggatcgaaacttgggtgctgaggcaccctggattcaccatcatggcagcgatcctcgcctacactataggtactacctactttcaaagggtgctgatcttcattctcctcaccgcagtggccccttcaatgaccatgaggtgcattgggatctcgaaccgggacttcgtcgaaggagtgtccggaggtagctgggtcgacatcgtcctggaacacggaagctgcgtgactactatggcgaagaacaagccaaccttggacttcgagcttatcaagaccgaggcgaagcacccggccactctgagaaagtactgcatcgaggctaagctcaccaacacgaccactgcctcgcgatgcccaactcagggagaaccgtcactgaacgaagaacaggataaacgctttgtgtgcaagcatagcatggtggatagaggctggggaaacggctgtggactcttcggaaagggtggaattgtgacgtgcgcaatgttcacttgcaagaagaatatggaagggaagatcgtccagccggagaacctggaatacactatcgtgatcaccccgcactcaggcgaggagaacgcagtgggcaacgataccgggaagcacgggaaggaaatcaaggtgaccccgcagtcgtccattaccgaggccgaactcaccggatacggcactgtgactatggaatgctcgccacggaccgggctggatttcaatgagatggtgctcttgcaaatggagaacaaagcctggctggtccaccgccagtggttcctcgacctcccccttccgtggctgccgggagctgacacccaaggatccaactggatccaaaaagaaacccttgtcacgtttaagaatccacatgccaaaaagcaggacgtggtcgtgctcggaagccaggaaggagccatgcacactgcgctgactggagcaaccgaaattcaaatgtcgagcggcaacctcctcttcactggacatctgaagtgccggctgcgcatggacaaactgcaacttaagggcatgtcatactcgatgtgtaccggcaaattcaaggtggtgaaggagatcgcggagactcagcacgggaccatcgtcatccgggtccagtatgagggtgatggttccccctgcaagatccctttcgaaatcatggatctggagaaacgtcacgtgctgggccggctgatcactgtgaatccgatcgttacggagaaagacagcccggtgaacatcgaagctgaaccgccgtttggggatagctacattatcatcggcgtggaaccaggccagctcaagttgtcgtggttcaagaaaggaggaggtggaggatccggaggcggagggtcgggcggtggtggatcggaggtcaaactgcagcaatcagggaccgaagtcgtgaagccgggggcttcagtcaagctgtcctgcaaggccagcggctatatcttcactagctacgacatcgattgggtgcggcagactccggagcaaggactcgagtggattgggtggatctttccgggcgagggatcaaccgagtacaacgaaaaatttaagggacgggcaacgctgtccgtggacaagagctcatctacggcgtacatggagctgacgcggctcacgtcagaggattccgccgtctacttctgtgccaggggcgactactaccggcgctactttgatctgtggggacaaggaacgaccgtgactgtctcatcaggcggcggcggatcgggaggaggcggatcgggtggcggtggttcggacattcagatgactcaatcgcccagcttcctgtcgacctcactggggaattctattacgatcacttgtcacgcttcgcagaacatcaagggttggctggcttggtaccagcagaaaagcggtaacgccccgcaactgctcatctacaaggcatcgtccctgcaatcgggagtgccgtcacgcttttcaggatcgggctccggaaccgattacatctttaccatcagcaacctgcagccggaagacatcgccacttactactgtcaacactatcagagctttccgtggacctttggaggggggaccaaattggagatcaagcgcgactacaaggatgacgatgacaaa

SEQ ID NO: 230 - DNA, 916 bp, Artificial Sequence
  Synthetic Polynucleotide
atggattggacctggatcttgtttctcgtcgccgcagccactcgcgttcatagcaaaggaatgtcatactccatgtgcacgggaaaattcaaggtggtcaaagagatcgcggagactcagcacggcaccatcgtcattcgcgtgcaaactgaaggagatggatctccctgcaagatcccgttcgagatcatggacctggaaaagagacacgtcctcggtagactgatcaccgtgaacccgatcgtgacggagaaggattccccggtgaatattgaagcagagcctccatttggggactcatacattatcattggggtcgagccgggccagctgaagctgaattggtttaagaagggctcgtcaatcggacagatgttcgaaactactatgaggggtgcaaagcggatggcgatcctctcgggcggagatatcatcaaactccttaacgaacaggtgaacaaggagatgcagtcctcaaacctttacatgagcatgtcgtcctggtgttacacccatagcctggacggcgctggattgttcctgtttgaccatgcagcggaggaatacgaacacgccaagaagctcatcatcttcctgaacgagaataacgtgccagtgcaactgacctccatctcggctcctgagcacaagttcgaaggactcacccagatcttccaaaaggcctacgaacacgaacagcacatcagcgaatccatcaacaatatcgtggaccatgctatcaaaagcaaagaccatgcgaccttcaacttcctgcaatggtatgtcgccgaacagcacgaagaggaggtgctgttcaaggacattctcgacaaaatcgaattgatagggaacgaaaatcacggtctgtacctggccgatcaatacgtgaagggaattgccaagtcgcggaagtcgt

SEQ ID NO: 231 - DNA, 2058 bp, Dengue Virus
atgctgaatattctgaaccgccgccgccggactgccgggattataattatgatgattcccaccgtgatggccttccacctgaccacccggaacggggaaccacatatgatcgtgtccagacaggagaagggaaagtccctgctgttcaagaccgaggacggcgtgaacatgtgcaccctcatggctatggacctgggcgaactctgcgaggacaccatcacctacaagtgccccctgttgaggcagaacgagccggaggatattgactgctggtgcaattcgaccagcacctgggtcacctacgggacttgcaccacaaccggagaacatcggcgcgaaaagcgcagcgtggctttggtgcctcacgtcggaatggggctggagactagaaccgagacttggatgtcgtcggaaggggcctggaaacacgcacagcgcatcgaaacttggatactcaggcatcccggcttcaccattatggccgcgatcctggcatacaccatcggtactacccacttccaacgggccctgatctttatcctcctgaccgctgtcgcaccatccatgaccatgcggtgtatcggtatcagcaacagggacttcgtggagggagtgtcgggaggatcctgggtggatattgtgctggaacacggttcctgcgtcactaccatggcgaagaacaagcctaccctggactttgagctgatcaaaactgaggccaagcagccggccaccctgcgcaagtactgcatcgaagccaagctgaccaataccactaccgaatcccgctgtccgacccaaggggagccctccctgaatgaggagcaggacaagcgcttcgtctgcaagcattcaatggtcgaccgcggctggggaaacggctgcggactgttcggaaagggcggcattgtgacctgtgccatgttcacttgcaagaagaacatggaaggaaagatcgtgcagcccgaaaacctggagtataccatcgtcgtgaccccgcactccggggaagaacacgctgtgggaaacgacaccggaaagcacggaaaggagatcaaagtgaccccacagtcgagcattaccgaggccgaacttactggttacggcactgtgacgatggaatgttcaccgagaactggactggatttcaacgaaatggtgctgctccaaatggaaaacaaggcctggctggtgcaccgccagtggtttcttgacctccctctcccttggctgcctggagcagacactcagggttccaactggattcagaaggaaacactcgtgaccttcaagaaccctcacgcgaagaagcaggatgtggtcgtgctgggaagccaggagggagcgatgcataccgccctcaccggcgcgacggagattcagatgtccagcggaaaccttctgttcaccggacacctgaagtgcagactgaggatggacaagctgcagctcaagggaatgtcctactccatgtgcactggaaagttcaaggtcgtgaaggagattgccgaaactcagcatggtaccatcgtgatccgggtgcaatatgaaggggacggatccccgtgcaagatccctttcgaaatcatggacttggagaagcgacacgtgctgggcagactgatcacagtcaaccccatcgtgactgagaaggattcacccgtgaacattgaagccgagccgcctttcggcgatagctacatcatcattggcgtggaaccgggacagcttaagctcaactggttcaagaagggttcctcgatcggtcaaatgtttgaaaccacgatgcggggtgccaaacggatggccattctgggagacaccgcctgggatttcggctccttgggcggagtgttcacttctatcggaaaggcgctgcaccaagtgttcggagccatctacggcgccgcgttctcgggcgtcagctggaccatgaagattctgatcggggtcatcatcacttggattgggatgaactcacggtccacctccctgagcgtgtcccttgtcctggtcggcatcgtgaccctgtacctcggagtgatggtgcaggcttag

SEQ ID NO: 232 - DNA, 2058 bp, Dengue Virus
atgcttaacattctcaaccgccgccggagaactgctggtattatcattatgatgattcccactgtgatggccttccacctgaccacgcggaacggcgaaccccatatgattgtcggtcggcaggaaaaggggaagtccctgctgttcaaaactgaggacggagtgaacatgtgcaccctcatggctattgacctgggagagctgtgcgaagatactatcacgtacaagtgccccctgctgcgccagaacgagcctgaggacattgactgctggtgcaactccacgtcaacctgggtcacctacggaacttgcgcgactaccggcgaacatcgcagagaaaagagaagcgtggccctcgtgccgcacgtcgggatggggctggaaacccggaccgaaacctggatgtcctcggaaggcgcctggaagcacgtgcagaggatcgaaacttggatcctccggcacccgggattcaccatcatggccgccatcctcgcttacacaatcggaaccactcactttcaacgcgccctgatcttcatcctgcttaccgccgtggccccgtccatgaccatgcgctgcattggaatgtcaaaccgggacttcgtcgagggagtctccggaggaagctgggtggacatcgtgctggagcacggcagctgtgtgaccaccatggccaagaacaagccaactcttgatttcgaactgatcaagaccgaggccaagcagcctgccactctgaggaagtactgtatcgaagcgaagctgaccaacaccactaccgaatcccgctgcccgacccagggcgaaccttccttgaacgaagaacaggacaagagattcgtgtgcaagcatagcatggtcgacaggggatgggggaacggatgtggactctttgggaagggcggaatcgtcacctgtgcgatgttccggtgcaagaagaacatggaggggaaggtcgtgcagcccgaaaatctcgagtacactatcgtgatcaccccgcattccggagaggagcacgccgtgggcaacgacaccgggaagcacggaaaggagatcaaaattacccctcaatcctccaccaccgaagccgaattgactggttacggtaccgtgactatggagtgctcgccgcggactggcttggacttcaacgagatggtgctgctgcaaatggagaacaaggcctggctggtgcaccggcagtggtttcttgatctgcctctgccttggctgcccggagccgacacccagggtagcaattggatccagaaagagacactcgtgacctttaagaacccgcacgcaaagaagcaggatgtcgtggtcctgggaagccaagaaggggcaatgcataccgcactcactggagccactgaaatccagatgtcctccggcaatctgctgttcaccggccatctgaagtgccgactgcgcatggacaagctccagcttaagggaatgtcctactccatgtgtactggaaagttcaaagtcgtgaaggaaattgccgaaacccagcacggcaccatagtgatccgggtgcagtacgagggcgacggctcaccctgcaaaatcccgttcgagattatggatctcgaaaagcgccacgtgctgggcagactgattaccgtgaaccctatcgtgaccgagaaggattccccagtgaacatcgaggccgaaccgcccttcggagactcgtatatcatcatcggcgtggagcccggccagctgaagctgaactggttcaagaaggggtcgagcatcggccagatgttcgagactaccatgcgcggcgcgaagaggatggcgatcctgggggataccgcttgggacttcggttccctcggcggggtgttcacctcgattgggaaggccctccaccaagtgttcggtgcaatctacggagcggcgttcagcggagtgtcgtggaccatgaagattctgatcggcgtgatcatcacctggattggcatgaactcccggtctactagcctgtcggtgaccctggtgctggtcggaatcgtgaccttgtacctgggagtgatggtgcaagcttag

SEQ ID NO: 233 - DNA, 2058 bp, Dengue Virus
atgctgaacatcctgaaccgcagaaggagaaccgccggtattattattatgatgatccccaccgtgatggcattccacctgactacccgcaacggagagccgcatatgatcgtgggccgccaggaaaagggaaagtccctgctgttcaagactgaggacggcgtgaacatgtgcactctcatggccatcgacctcggcgaactgtgcgaggacaccattacttacaagtgcccgctgctgagacagaacgagcctgaggacatcgactgttggtgtaactcgacctccacctgggtcacctacggaacgtgcgccacaaccggagaacaccgccgggaaaagcggagcgtggctctggtgccgcacgtcggaatgggtctggagactagaaccgaaacctggatgtcatccgagggggcatggaaacatgtgcagcgaatcgagacttggatcctgagacacccgggcttcactatcatggcggccatccttgcctacaccattggcactactcacttccaacgggcgctgatcttcatactgctcaccgcggtggccccctccatgacgatgcgctgcatcggaatctccaaccgggacttcgtggagggcgtcagcggaggcagctgggtggacatcgtgttggagcacggaagctgcgtgaccaccatggccaagaacaagcccactcttgattttgagctgatcaagacggaagcaaagcagccggccactctgaggaagtactgcatcgaggccaagctcaccaacacaaccaccgaatctcggtgcccgacccaaggagagccatcactgaacgaggaacaggacaagagattcctgtgcaaacattcgatggtggacaggggatggggaaatggttgcggcctgttcggcaaaggaggcattgtgacctgtgcgatgttcacttgcaagaaaaacatggaggggaaggtcgtgttgccggagaacctggagtacactatcgtgattaccccgcactccggggaggaacatgccgtgggaaatgacaccggaaagcacgggaaggaaatcaaaatcacgcctcagtcctcaatcaccgaagccgagcttaccggctacggtaccgtgaccatggagtgcagccctcggactggactggacttcaacgagatggtgctgctgcaaatggaagataaggcctggctggtgcaccggcagtggttcttggatttgccactgccttggctgcccggcgcggatacccagggttccaactggattcagaaggaaaccctcgtgaccttcaagaatcctcacgccaagaagcaggacgtggtggtgctgggttcccaagaaggggccatgcatactgccctcactggagcgaccgaaatccagatgtcgtccggcaacctcctgttcaccggccacctgaagtgccgcctgcggatggacaagttgcagctgaagggaatgagctactcgatgtgtaccggaaagttcaagatcgtgaaggaaatcgccgaaacccagcacggaaccatcgtcattagagtgcagtacgaaggggacggcagcccgtgcaagatccccttcgaaattatggacctggagaagcgccacgtgctcggaaggctcatcactgtcaacccaatcgtcaccgaaaaggactcccctgtgaacatcgaagcagagccccctttcggggactcctacattattatcggcgtggagcccggccagctgaagctgaactggttcaagaagggatcctcgatcggacagatgttcgaaaccaccatgcggggagccaagcggatggctattctgggagataccgcttgggatttcggctccctcggcggcgtctttacttccatcgggaaagcgctccaccaagtgtttggagccatctacggtgccgctttttccggggtgtcatggaccatgaagattcttatcggggtcattattacttggatcggcatgaactcccggagcacctcgctgtccgtgagcctcgtgctcgtgggggtggtcactctgtatcttggtgccatggtgcaggcctag

SEQ ID NO: 234 - DNA, 2058 bp, Dengue Virus
atgcttaacatcctgaatagaagaagaagaaccgccggcattatcattatgatgatacccaccgtgatggccttccacctgactactcgcaacggagagcctcatatgatcgtgtcgcggcaggagaagggaaagtccctgctgtttaagacggaggacggcgtgaacatgtgcactcttatggcaatggaccttggagagctgtgcgaggataccatcacctacaagtgtccgttcctgaagcaaaacgagcctgaggatattgactgctggtgcaactccacctcaacctgggtcacatatgggacctgtaccactactggcgaacaccgccgcgagaaaagaagcgtggcgttggtgcctcacgtcggcatgggtctggaaactcggaccgaaacttggatgagctcagagggggcatggaagcacgcccagaggattgaaacctggattctgcgccaccctggattcaccatcatggcggctattctggcgtacactattggaaccacccactttcagcgggcccttatcttcatcctcctcactgccgtggcgccctccatgactatgcggtgtatcggaatttccaaccgcgacttcgtggaaggagtgtccggaggctcctgggtcgacattgtgctggaacatggttcatgcgtgaccacgatggccaagaacaagcccaccctcgacttcgagctgatcgagactgaagccaagcagccggccactctgcggaagtactgtatcgaggccaagctcaccaacaccaccaccgattcccgctgcccgacccaaggagaaccttcgctcaacgaggagcaggacaagcggttcgtgtgcaagcacagcatggtcgacaggggatgggggaatggatgcggtctgttcggaaagggaggcattgtgacttgtgcaatgttcacttgcaagaagaacatgaaggggaaggtcgtgcagccggaaaacctggagtacaccatcgtgatcacccctcattcgggcgaagaacacgctgtggggaatgataccggaaagcacggaaaggaaattaagatcacaccccaatccagcatcactgaggcagaactgaccggctacggcactgtgaccatggagtgctcgcctcggactggcctggacttcaacgagatggtgctgctccaaatggaaaacaaggcctggctggtgcacagacagtggttcctcgatttgcccttgccgtggctccctggcgccgacacccagggatctaactggatccagaaggaaacccttgtgaccttcaagaacccgcacgctaagaaacaggatgtggtggtgctgggaagccaggaaggagcaatgcataccgcgctcacgggtgccaccgagatccagatgagctccgggaacctcctgttcaccggtcacctgaagtgccgactccgcatggacaaactgcagctcaaggggatgtcctactccatgtgcaccgggaaattcaaggtcgtgaaggagatcgctgagactcagcacggtactatcgtgatccgggtgcagtatgagggagatgggagcccgtgcaaaatcccatttgagatcatggacttggaaaagcgccatgtgctgggtcggctgattaccgtgaacccaatcgtcaccgaaaaggacagccccgtcaacattgaagccgaaccacccttcggagactcgtacatcatcattggcgtggaaccgggccagctgaagctgaactggttcaaaaaggggtcctctatcggccaaatgatcgaaaccaccatgcggggagctaagcggatggcgattttgggagacactgcgtgggactttggctcactggggggagtgttcaccagcatcggcaaagccctgcaccaagtgttcggtgccatctacggagccgccttcagcggagtgtcctggatcatgaagatcctgatcggcgtgatcattacctggatcggcatgaactccaggtccacctcgctctccgtgtcgctggtgctggtcggggtcgtgaccctgtacctgggagtgatggtccaggcctga

SEQ ID NO: 235 - DNA, 2058 bp, Dengue Virus
atgttgaatatcctgaaccgccgccggagaactgccggaattatcattatgatgatccctaccgtgatggcgttccaccttactacccggaacggggagcctcacatgatcgtgtcacgccaggagaaggggaaatccctgctgttcaagaccaaggacggtaccaacatgtgtaccctgatggcgatggacctcggagagctgtgcgaggacaccatcacctacaaatgcccgttcctgaagcagaacgagccggaagatattgactgttggtgcaactccacctccacttgggtcacctacggaacttgcaccactactggggagcatagacgggagaagcgctccgtggccctggtgccgcacgtcggcatgggactggaaaccagaaccgagacttggatgtccagcgaaggcgcctggaagcacgcccagcggattgaaacttggatcctgaggcacccgggttttaccattatggccgctatcttggcatacaccatcggcaccacccacttccaacgcgtcctgatcttcatcctgctgaccgccattgcgccctccatgaccatgcggtgcatcggaatcagcaaccgcgacttcgtggaaggcgtcagcggcggttcttgggtggacatcgtgttggagcacggatcgtgcgtgaccaccatggccaagaacaagccgaccctcgatttcgagctgatcaagactgaagccaagcagccagctaccctgcggaagtattgcatcgaagccaagctcactaatactacgaccgacagccggtgtccgacccaaggagagcccaccctgaatgaggaacaagacaagcgcttcgtgtgcaagcattccatggtggaccggggctggggaaacggctgcggactgttcgggaaaggaggaattgtgacttgcgccatgttcacttgcaagaagaacatggaggggaagatcgtccagcctgagaacctcgagtacacggtcgtgattactccgcactcgggagaagaacacgccgtgggcaacgacaccggaaagcatgggaaggaagtgaaaatcacgccccaatcgtcgattaccgaggctgagctgaccggctacggcaccgtgaccatggagtgctccccgaggaccggactggacttcaacgaaatggtgctgctgcagatgaaggacaaggcctggctggtgcaccgccagtggttcctcgacctcccactcccctggctgcccggagcggatacgcagggatccaactggatccagaaggaaactcttgtgaccttcaagaaccctcatgccaagaagcaggacgtggtggtcctgggatcccaagagggcgcgatgcacaccgcactgaccggcgccaccgaaattcagatgtcctccggaaacctcctgttcactggccacctgaagtgcagactccgcatggacaagctgcagctcaaggggatgagctactccatgtgtaccggaaaattcaaggtcgtgaaggaaattgcagaaacacagcatgggacaattgtcattcgggtccagtacgagggcgatggttcaccgtgcaagactccattcgagatcatggatctggagaaaagacacgtgctgggtcggctgactaccgtgaacccaatcgtgactgagaaggactcccccgtgaacatcgaagccgagcctccttttggcgattcctacatcatcattggagtggaacccggacagcttaagttggattggttcaagaagggctcctcgatcggacagatgttcgaaaccaccatgcgcggtgccaagcgaatggccatcctgggggacaccgcctgggacttcggtagcctgggcggagtgtttacctcaattggaaaggctctgcaccaagtgtttggggcgatctacggagcggccttcagcggtgtctcctggactatgaagattctcatcggagtgataatcacctggatcggcatgaacagccggtcaaccagcctgtccgtgtccctggtgctggtcggcatcgtgactctctacctcggagtgatggtgcaggcctag

SEQ ID NO: 236 - DNA, 2058 bp, Dengue Virus
atgctcaacatactgaacagacggagaaggaccgccggtattattatcatgatgatccctactgtgatggcattccacctgacaacccgcaacggagagccccacatgatcgtgtcacgccaggagaaagggaagtcactgctgttcaagaccgaagtcggcgtgaacatgtgtaccctgatggcgatggatcttggcgaactgtgcgaggacaccatcacgtacaagtgccccctgttgcggcaaaacgaaccagaggacatcgactgctggtgtaactccacctcgacctgggtcacctacggaacctgtaccactatgggggaacaccggcgggagaagcgctccgtggcgctcgtgcctcatgtcggcatgggactggagactcggactgaaacctggatgtcgtcggagggggcctggaagcacgtccagcggatcgagacttggatccttcgccatccgggcttcaccatgatggccgccatcctggcctacaccatcggaaccacccatttccaacgggccctgatcctgatcctgttgactgccgtgaccccctccatgactatgcggtgcattgggatgtcgaacagggatttcgtggagggagtcagcggtggcagctgggtggacatcgtgctggaacatggatcctgcgtgactaccatggcaaagaacaagccaaccctcgatttcgaactgatcaagaccgaggcgaaacagccggcgaccctgaggaagtactgcatcgaggccaagctcaccaacaccactaccgagagcagatgccctacccaaggggaaccttccctgaacgaggagcaggacaagagattcgtctgcaagcactccatggtggaccgcggctggggaaacggatgcggactcttcggaaagggcggtattgtgacctgtgccatgttccgctgcaagaaaaacatggaagggaaagtggtgcagcccgagaacctcgagtacactatcgtgatcacaccgcacagcggagaagaacacgccgtgggcaacgacactggaaagcacgggaaggaaatcaagatcaccccgcaatcctcaatcactgaggctgagttgaccggctacgggactattaccatggaatgctccccacgaacgggactggacttcaacgaaattgtgttgctccaaatggaaaacaaggcctggctcgtgcaccggcagtggttcctggatctgcccctgccgtggctgccgggtgccgacactcaggggagcaactggattcagaaggaaacccttgtgaccttcaagaacccccacgcaaagaagcaggacgtggtggtgctgggtagccaagaaggcgccatgcacacggccctgaccggagcgaccgagatccagatgtccagcggaaatctgctctttactggtcatctgaagtgcagacttcggatggacaagctgcaactgaagggaatgtcctactcaatgtgcactggaaagttcaaggtcgtgaaggagatcgccgaaacccagcacgggactatcgtcatccgcgtgcagtacgaaggagatggctccccgtgcaagatccctttcgaaatcatggacctggagaagcgccacgtgttggggcgccttattactgtgaaccccatcgtgaccgagaaggactcccctgtcaacatcgaggctgaaccgccattcggagattcctatatcattatcggagtggaaccgggccagctcaagctgaattggttcaagaagggatcctcgattggccagatgttcgaaacgactatgcggggcgctaagcgcatggccatcctgggcgatactgcctgggattttggttctctgggcggagtgttcacctccattggaaaggccctgcaccaagtgttcggcgccatctacggtgccgcgtttagcggtgtctcatggaccatgaaaatcctcattggcgtgatcattacctggattggcatgaactccagaagcacttccctgtccgtgaccctggtgctcgtcggaattgtgacactctacctcggagtgatggtgcaggcttga

SEQ ID NO: 237 - DNA, 2058 bp, Dengue Virus
atgctgaacattttgaacagacgccgaaggaccgcaggcattatcattatgatgatccctaccgtgatggccttccatctgactactaggaacggagagccacatatgatcgtgtcgcgccaggaaaagggaaagagcctgctttttaaaaccaaggacggcacgaacatgtgcacccttatggccatggacctgggggagttgtgcgaggacaccatcacctacaagtgcccgttcctgaagcaaaacgagcccgaagatattgactgctggtgcaactccacctccacctgggtcacttatgggacttgcaccaccaccggcgaacatcgcagagaaaagagaagcgtggccctggtcccccacgtcgggatgggcctcgagactcggaccgaaacttggatgtcatcagagggcgcatggaagcatgctcagcggatcgaaacctggatcctgagacaccctggtttcacaattatggccgccattcttgcgtacacgatcggaacgactcatttccaacgcgtgctgatcttcattctcctgaccgctattgcgccgtccatgactatgcggtgcatcggaatctcaaaccgggacttcgtggaaggagtgtcgggaggatcctgggtggacattgtgctggagcacggttcctgcgtcaccaccatggccaaaaacaagcctaccctggacttcgagctgatcaagactgaggccaagcagcccgcgaccctccggaagtactgcatcgaggccaagttgaccaacactactaccgattcccggtgcccgacccaaggagaaccaactctgaacgaagaacaggataagcggtttgtgtgcaagcactcaatggtggacaggggatggggcaacggctgtggactgttcggaaagggtggtattgtgacctgtgcaatgtttacctgtaaaaagaatatggaggggaagatcgtgcagcctgaaaatctcgagtacactgtcgtcatcaccccgcactcgggagaggagcacgctgtgggcaacgacaccggaaagcacggaaaggaggtcaagataaccccgcaatcctccattacggaagccgaactgactggttacggcaccgtgactatggagtgctcccctcggaccggcctggacttcaacgaaatggtgctgctccaaatggaagataaggcctggctggtgcacaggcagtggttcctggatctcccgctgccgtggctgcctggcgctgacactcagggaagcaactggatccagaaggaaaccctcgtgacctttaagaacccccacgccaagaagcaggatgtggtggtgttgggaagccaggagggggccatgcatactgccctcaccggcgcgaccgaaatccagatgtcgtccggcaatctgctgttcaccggacacctcaagtgtcgccttcggatggacaagctgcagctgaagggaatgagctacagcatgtgcaccgggaagttcaagatcgtgaaggaaatcgccgaaacccagcacggaaccatcgtgatccgggtgcagtacgagggcgacggttctccctgcaaaatccccttcgaaatcatggatctggagaagagacacgtcctgggtcgcctgatcaccgtgaaccccattgtgactgagaaggactccccagtgaacatcgaagcggagcccccattcggagacagctacattatcattggtgccgaaccggggcagctgaaactggactggttcaagaagggcagctcgattggccaaatgttcgaaacgacaatgcggggcgcaaagcgcatggccatcctgggagacactgcctgggacttcgggtcccttgggggggtgttcacctcgatcggaaaagccttgcaccaagtgttcggcgcaatctacggcgccgcgttctcgggagtctcctggactatgaagatcctgatcggtgtcatcatcacctggatcgggatgaactcccggtccacttccctctcggtgtcactcgtgcttgtgggaattgtcaccctgtacctcggagtgatggtgcaggcctga

SEQ ID NO: 238 - DNA, 2058 bp, Dengue Virus
atgctgaatattctgaaccgacgccgccgcactgccggaatcattatcatgatgatccctaccgtgatggcgttccatctcaccactcggaatggcgaaccccatatgatcgtgtcgagacaggaaaagggaaagagccttttgttcaaaactgaagatggagtgaacatgtgcactctcatggcaatggatctgggcgaactgtgcgaagataccatcacttacaagtgtccgctgttgagacagaacgagcctgaggacatcgactgctggtgtaacagcacttccacctgggtcacctacggcacttgcactaccaccggagaacaccggcgcgagaagaggagcgtggctcttgtgccgcacgtcggcatgggactcgagactcggaccgaaacctggatgtcatccgaaggagcctggaaacacgcccaacggatcgaaatttggatcctgagacaccccggtttcactatcatggccgcaatcctggcgtacactattggcaccacgcacttccagagggccctcattttcatcctcctgactgccgtggcgccatccatgaccatgagatgtattggcatttccaaccgcgatttcgtggagggagtgtccggaggatcctgggtcgacatcgtgctggaacacggatcttgcgtcaccaccatggctaagaacaagcccaccctcgacttcgagctgatcaagacagaagccaagcagccggccaccctccgcaagtattgcattgaagccaagcttaccaacaccaccaccgagtcgcggtgcccaacccaaggagagccgagcctcaatgaggaacaggacaagcgcttcgtgtgcaaacacagcatggtcgaccggggttggggcaacggatgtggcctgttcgggaagggtggcattgtgacttgcgcaatgttcacttgcaagaagaacatggaggggaaagtggtgcaacccgagaacctggagtacaccatcgtcgtgaccccacactccggagaggagcacgccgtgggaaacgacacggggaagcatggaaaggagatcaaggtcacaccccaatcatctattaccgaggccgaactgaccggatacggtactgtgacgatggagtgcagcccgaggactggactggacttcaacgaaatggtgctgctgcaaatggagaacaaggcctggctcgtgcaccggcagtggtttctggatctcccactgccgtggttgccgggagccgacacccaggggtcgaactggatccagaaggaaactcttgtgacgtttaagaatcctcacgcgaagaagcaggacgtggtggtcctgggatcgcaggaaggagctatgcacaccgctctgaccggcgccactgagatccagatgtcctcgggcaacctcctgttcaccggtcatctgaagtgccggctgcggatggacaaattgcagctgaaggggatgtcctactccatgtgcaccgggaagttcaaggtcgtgaaggagatcgcggaaactcagcacggcaccattgtcattagagtgcagtacgagggagatggttcaccgtgcaagataccgttcgaaatcatggacctggaaaagagacatgtcttgggacgcctgatcactgtgaaccctatcgtgaccgaaaaggactcccctgtgaacatcgaggcggagccgcctttcggcgactcctacatcattatcggagtggagcccgggcagctgaagctcaactggtttaagaaggggtccagcatcggccagatgttcgaaaccaccatgcggggggcgaagaggatggcgatcctgggagacaccgcctgggatttcggttcactgggcggagtgttcacctccatcggaaaggccctgcaccaagtgttcggcgcaatctacggtgctgccttctcgggagtctcctggaccatgaagatcctgatcggcgtgattatcacatggatcggcatgaacagccggtcaacctccctttccgtgtccctggtgctggtcggcatcgtgactctgtacctgggcgtgatggtgcaggcctga

SEQ ID NO: 239 - DNA, 2058 bp, Dengue Virus
atgctgaacattctgaaccggagaagaagaaccgccggcattattatcatgatgattcccactgtgatggcatttcacctgaccacccggaacggagaacctcatatgatcgtgtcgagacaggagaagggaaagtccctgctgttcaagacagaaaacggagtgaacatgtgcaccctgatggccatggatctcggcgaactgtgcgaggatactatcacctacaactgtccgttgctgcgccaaaacgagccggaggacatcgactgctggtgtaactccacgtcgacctgggtcacctacggcacttgcaccgcgaccggcgaacacagaagagagaaacgctccgtcgctctggtgccgcacgtcgggatggggcttgaaacccggactgaaacctggatgagctcggagggcgcttggaagcatgcccagcgcatcgaaacttgggtgctgaggcatccaggcttcacaatcatggccgccatcctcgcgtacaccatcggtactacgtacttccagcgggtgttgatcttcattctgctgaccgccgtggcccctagcatgaccatgcggtgcatcgggatctccaaccgcgatttcgtggagggggtgtccggtggaagctgggtggacattgtgctggagcacggctcgtgcgtgaccaccatggccaagaacaagcccacccttgattttgagctgatcaagaccgaagcgaaacaccccgcgaccctccggaagtactgcattgaagccaagctcaccaacactaccacggcctcccggtgccctacccaaggagaaccttccttgaacgaagaacaggacaagcgcttcgtgtgcaagcattcaatggtggaccggggctggggaaatggctgtggcctcttcggaaaaggcggaattgtgacttgcgcaatgttcacttgcaagaagaacatggagggaaagattgtgcagcccgagaacctcgagtacactattgtcatcactccccactccggcgaagaaaacgctgtcggcaacgacaccggaaagcatggaaaggagatcaaggtcaccccgcaatcctcaattactgaggcagaactgaccggttacggaactgtgactatggagtgttcccctcgcaccggcctcgatttcaacgagatggtgctgctgcaaatggagaacaaggcctggctggtgcaccggcagtggttcctcgatttgcccctgccgtggctgccgggagccgacactcagggatccaactggatccagaaagaaaccctcgtgaccttcaaaaacccccacgcgaagaagcaggacgtggtggtgctgggttcccaagaaggggcgatgcataccgccctgactggtgctaccgaaatccagatgtcaagcggaaatctcctgtttaccggtcacctgaagtgcaggctccggatggacaagttgcagctgaaggggatgtcgtacagcatgtgtactgggaagttcaaggtcgtgaaggagattgccgaaacccagcacggaaccatagtcatcagggtccagtacgagggcgacggcagcccttgcaagatcccgttcgagatcatggatctggagaagcgacacgtgctgggccggcttatcactgtgaatccaatcgtgaccgagaaagactcgcccgtgaacatcgaagccgagccgccgttcggcgactcatacatcatcatcggcgtggaaccaggacagctgaagctgtcatggttcaagaagggttccagcattggtcagatgttcgaaacaacgatgcgcggagccaagcgcatggctatccttggggacaccgcctgggacttcgggtcgctgggaggagtgtttaccagcatcggaaaggccctgcaccaagtgttcggtgccatctacggagccgcattttccggagtgtcgtggactatgaagattctgatcggcgtcgtgattacctggatcgggatgaactccaggtctacttccctctccgtgagcctggtgctggtcggcgtggtcaccctgtatctgggcgtgatggtccaggcttag

SEQ ID NO: 240 - RNA, 10735 nt, Dengue Virus
aguuguuagucuacguggaccgacaagaacaguuucgaaucggaagcuugcuuaacguaguucuaacaguuuuuuauuagagagcagaucucugaugaacaaccaacggaaaaagacgggucgaccgucuuucaauaugcugaaacgcgcgagaaaccgcgugucaacuguuucacaguuggcgaagagauucucaaaaggauugcuuucaggccaaggacccaugaaauuggugauggcuuuuauagcauuccuaagauuucuagccauaccuccaacagcaggaauuuuggcuagauggggcucauucaagaagaauggagcgaucaaaguguuacgggguuucaagaaagaaaucucaaacauguugaacauaaugaacaggaggaaaagaucugugaccaugcuccucaugcugcugcccacagcccuggcguuccaucugaccacccgagggggagagccgcacaugauaguuagcaagcaggaaagaggaaaaucacuuuuguuuaagaccucugcaggugucaacaugugcacccuuauugcaauggauuugggagaguuaugugaggacacaaugaccuacaaaugcccccggaucacugagacggaaccagaugacguugacuguuggugcaaugccacggagacaugggugaccuauggaacauguucucaaacuggugaacaccgacgagacaaacguuccgucgcacuggcaccacacguagggcuuggucuagaaacaagaaccgaaacguggauguccucugaaggcgcuuggaaacaaauacaaaaaguggagaccugggcucugagacacccaggauucacggugauagcccuuuuucuagcacaugccauaggaacauccaucacccagaaagggaucauuuuuauuuugcugaugcugguaacuccauccauggccaugcggugcgugggaauaggcaacagagacuucguggaaggacugucaggagcuacguggguggaugugguacuggagcauggaaguugcgucacuaccauggcaaaagacaaaccaacacuggacauugaacucuugaagacggaggucacaaacccugccguccugcgcaaacugugcauugaagcuaaaauaucaaacaccaccaccgauucgagauguccaacacaaggagaagccacgcugguggaagaacaggacacgaacuuugugugucgacgaacguucguggacagaggcuggggcaaugguugugggcuauucggaaaagguagcuuaauaacgugugcuaaguuuaagugugugacaaaacuggaaggaaagauaguccaauaugaaaacuuaaaauauucagugauagucaccguacacacuggagaccagcaccaaguuggaaaugagaccacagaacauggaacaacugcaaccauaacaccucaagcucccacgucggaaauacagcugacagacuacggagcucuaacauuggauuguucaccuagaacagggcuagacuuuaaugagaugguguuguugacaaugaaaaaaaaaucauggcucguccacaaacaaugguuucuagacuuaccacugccuuggaccucgggggcuucaacaucccaagagacuuggaauagacaagacuugcuggucacauuuaagacagcucaugcaaaaaagcaggaaguagucguacuaggaucacaagaaggagcaaugcacacugcguugacuggagcgacagaaauccaaacgucuggaacgacaacaauuuuugcaggacaccugaaaugcagauuaaaaauggauaaacugauuuuaaaagggaugucauauguaaugugcacagggucauucaaguuagagaaggaaguggcugagacccagcauggaacuguucuagugcagguuaaauacgaaggaacagaugcaccaugcaagauccccuucucgucccaagaugagaagggaguaacccagaaugggagauugauaacagccaaccccauagucacugacaaagaaaaaccagucaacauugaagcggagccaccuuuuggugagagcuacauugugguaggagcaggugaaaaagcuuugaaacuaagcugguucaagaagggaagcaguauagggaaaauguuugaagcaacugcccguggagcacgaaggauggccauccugggagacacugcaugggacuucgguucuauaggagggguguucacgucugugggaaaacugauacaccagauuuuugggacugcguauggaguuuuguucagcgguguuucuuggaccaugaagauaggaauagggauucugcugacauggcuaggauuaaacucaaggagcacgucccuuucaaugacguguaucgcaguuggcauggucacacuguaccuaggagucaugguucaggcggacucgggauguguaaucaacuggaaaggcagagaacucaaauguggaagcggcauuuuugucaccaaugaaguccacaccuggacagagcaauauaaauuccaggccgacuccccuaagagacuaucagcggccauugggaaggcaugggaggaggguguguguggaauucgaucagccacucgucucgagaacaucauguggaagcaaauaucaaaugaauuaaaccacaucuuacuugaaaaugacaugaaauuuacaguggucguaggagacguuaguggaaucuuggcccaaggaaagaaaaugauuaggccacaacccauggaacacaaauacucguggaaaagcuggggaaaagccaaaaucauaggagcagauguacagaauaccaccuucaucaucgacggcccaaacaccccagaaugcccugauaaccaaagagcauggaacauuugggaaguugaagacuauggauuuggaauuuucacgacaaacauaugguugaaauugcgugacuccuacacucaagugugugaccaccggcuaaugucagcugccaucaaggauagcaaagcaguccaugcugacaugggguacuggauagaaagugaaaagaacgagacuuggaaguuggcaagagccuccuucauagaaguuaagacaugcaucuggccaaaaucccacacucuauggagcaauggaguccuggaaagugagaugauaaucccaaagauauauggaggaccaauaucucagcacaacuacagaccaggauauuucacacaaacagcagggccguggcacuugggcaaguuagaacuagauuuugauuuaugugaagguaccacuguuguuguggaugaacauuguggaaaucgaggaccaucucuuagaaccacaacagucacaggaaagacaauccaugaauggugcuguagaucuugcacguuacccccccuacguuucaaaggagaagacgggugcugguacggcauggaaaucagaccagucaaggagaaggaagagaaccuaguuaagucaauggucucugcagggucaggagaaguggacaguuuuucacuaggacugcuaugcauaucaauaaugaucgaagagguaaugagauccagauggagcagaaaaaugcugaugacuggaacauuggcuguguuccuccuucucacaaugggacaauugacauggaaugaucugaucaggcuauguaucaugguuggagccaacgcuucagacaagauggggaugggaacaacguaccuagcuuugauggccacuuucagaaugagaccaauguucgcagucgggcuacuguuucgcagauuaacaucuagagaaguucuucuucuuacaguuggauugagucugguggcaucuguagaacuaccaaauuccuuagaggagcuaggggauggacuugcaaugggcaucaugauguugaaauuacugacugauuuucagucacaucagcuaugggcuaccuugcugucuuuaacauuugucaaaacaacuuuuucauugcacuaugcauggaagacaauggcuaugauacugucaauuguaucucucuucccuuuaugccuguccacgacuucucaaaaaacaacauggcuuccgguguugcugggaucucuuggaugcaaaccacuaaccauguuucuuauaacagaaaacaaaaucuggggaaggaaaagcuggccucucaaugaaggaauuauggcuguuggaauaguuagcauucuucuaaguucacuucucaagaaugaugugccacuagcuggcccacuaauagcuggaggcaugcuaauagcauguuaugucauaucuggaagcucggccgauuuaucacuggagaaagcggcugaggucuccugggaagaagaagcagaacacucuggugccucacacaacauacuaguggagguccaagaugauggaaccaugaagauaaaggaugaagagagagaugacacacucaccauucuccucaaagcaacucugcuagcaaucucagggguauacccaaugucaauaccggcgacccucuuugugugguauuuuuggcagaaaaagaaacagagaucaggagugcuaugggacacacccagcccuccagaaguggaaagagcaguccuugaugauggcauuuauagaauucuccaaagaggauuguugggcaggucucaaguaggaguaggaguuuuucaagaaggcguguuccacacaauguggcacgucaccaggggagcuguccucauguaccaagggaagagacuggaaccaaguugggccagugucaaaaaagacuugaucucauauggaggagguuggagguuucaaggauccuggaacgcgggagaagaagugcaggugauugcuguugaaccggggaagaaccccaaaaauguacagacagcgccggguaccuucaagaccccugaaggcgaaguuggagccauagcucuagacuuuaaacccggcacaucuggaucuccuaucgugaacagagagggaaaaauaguaggucuuuauggaaauggaguggugacaacaagugguaccuacgucagugccauagcucaagcuaaagcaucacaagaagggccucuaccagagauugaggacgagguguuuaggaaaagaaacuuaacaauaauggaccuacauccaggaucgggaaaaacaagaagauaccuuccagccauaguccgugaggccauaaaaagaaagcugcgcacgcuagucuuagcucccacaagaguugucgcuucugaaauggcagaggcgcucaagggaaugccaauaagguaucagacaacagcagugaagagugaacacacgggaaaggagauaguugaccuuaugugucacgccacuuucacuaugcgucuccugucuccugugagaguucccaauuauaauaugauuaucauggaugaagcacauuuuaccgauccagccagcauagcagccagaggguauaucucaacccgaguggguaugggugaagcagcugcgauuuucaugacagccacuccccccggaucgguggaggccuuuccacagagcaaugcaguuauccaagaugaggaaagagacauuccugaaagaucauggaacucaggcuaugacuggaucacugauuucccagguaaaacagucugguuuguuccaagcaucaaaucaggaaaugacauugccaacuguuuaagaaagaaugggaaacgggugguccaauugagcagaaaaacuuuugacacugaguaccagaaaacaaaaaauaacgacugggacuauguugucacaacagacauauccgaaaugggagcaaacuuccgagccgacaggguaauagacccgaggcggugccugaaaccgguaauacuaaaagauggcccagagcgugucauucuagccggaccgaugccagugacuguggcuagcgccgcccagaggagaggaagaauuggaaggaaccaaaauaaggaaggcgaucaguauauuuacaugggacagccucuaaacaaugaugaggaccacgcccauuggacagaagcaaaaaugcuccuugacaacauaaacacaccagaagggauuaucccagcccucuuugagccggagagagaaaagagugcagcaauagacggggaauacagacuacggggugaagcgaggaaaacguucguggagcucaugagaagaggagaucuaccugucuggcuauccuacaaaguugccucagaaggcuuccaguacuccgacagaagguggugcuuugauggggaaaggaacaaccagguguuggaggagaacauggacguggagaucuggacaaaagaaggagaaagaaagaaacuacgaccccgcuggcuggaugccagaacauacucugacccacuggcucugcgcgaauucaaagaguucgcagcaggaagaagaagcgucucaggugaccuaauauuagaaauagggaaacuuccacaacauuuaacgcaaagggcccagaacgccuuggacaaucugguuauguugcacaacucugaacaaggaggaaaagccuauagacacgccauggaagaacuaccagacaccauagaaacguuaaugcuccuagcuuugauagcugugcugacugguggagugacguuguucuuccuaucaggaaggggucuaggaaaaacauccauuggccuacucugcgugauugccucaagugcacuguuauggauggccaguguggaaccccauuggauagcggccucuaucauacuggaguucuuucugaugguguugcuuauuccagagccggacagacagcgcacuccacaagacaaccagcuagcauacguggugauaggucuguuauucaugauauugacaguggcagccaaugagaugggauuacuggaaaccacaaagaaggaccuggggauuggucaugcagcugcugaaaaccaccaucaugcugcaaugcuggacguagaccuacauccagcuucagccuggacucucuaugcaguggccacaacaauuaucacucccaugaugagacacacaauugaaaacacaacggcaaauauuucccugacagcuauugcaaaccaggcagcuauauugaugggacuugacaagggauggccaauaucaaagauggacauaggaguuccacuucucgccuuggggugcuauucucaggugaacccgcugacgcugacagcggcgguauugaugcuaguggcucauuaugccauaauuggacccggacugcaagcaaaagcuacuagagaagcucaaaaaaggacagcagccggaauaaugaaaaacccaacugucgacgggaucguugcaauagauuuggacccugugguuuacgaugcaaaauuugaaaaacagcuaggccaaauaauguuguugauacuuugcacaucacagauccuccugaugcggaccacaugggccuugugugaauccaucacacuagccacuggaccucugacuacgcuuugggagggaucuccaggaaaauucuggaacaccacgauagcgguguccauggcaaacauuuuuaggggaaguuaucuagcaggagcaggucuggccuuuucauuaaugaaaucucuaggaggagguaggagaggcacgggagcccaaggggaaacacugggagaaaaauggaaaagacagcuaaaccaauugagcaagucagaauucaacacuuacaaaaggagugggauuauagagguggauagaucugaagccaaagagggguuaaaaagaggagaaacgacuaaacacgcagugucgagaggaacggccaaacugaggugguuuguggagaggaaccuugugaaaccagaagggaaagucauagaccucgguuguggaagagguggcuggucauauuauugcgcugggcugaagaaagucacagaagugaaaggauacacgaaaggaggaccuggacaugaggaaccaaucccaauggcaaccuauggauggaaccuaguaaagcuauacuccgggaaagauguauucuuuacaccaccugagaaaugugacacccucuugugugauauuggugaguccucuccgaacccaacuauagaagaaggaagaacguuacguguucuaaagaugguggaaccauggcucagaggaaaccaauuuugcauaaaaauucuaaaucccuauaugccgagugugguagaaacuuuggagcaaaugcaaagaaaacauggaggaaugcuagugcgaaauccacucucaagaaacuccacucaugaaauguacuggguuucauguggaacaggaaacauugugucagcaguaaacaugacaucuagaaugcugcuaaaucgauucacaauggcucacaggaagccaacauaugaaagagacguggacuuaggcgcuggaacaagacauguggcaguagaaccagagguggccaaccuagauaucauuggccagaggauagagaauauaaaaaaugaacacaaaucaacauggcauuaugaugaggacaauccauacaaaacaugggccuaucauggaucauaugaggucaagccaucaggaucagccucauccauggucaaugguguggugagacugcuaaccaaaccaugggaugucauucccauggucacacaaauagccaugacugacaccacacccuuuggacaacagaggguguuuaaagagaaaguugacacgcguacaccaaaagcgaaacgaggcacagcacaaauuauggaggugacagccaggugguuaugggguuuucucucuagaaacaaaaaacccagaaucugcacaagagaggaguucacaagaaaagucaggucaaacgcagcuauuggagcaguguucguugaugaaaaucaauggaacucagcaaaagaggcaguggaagaugaacgguucugggaccuugugcacagagagagggagcuucauaaacaaggaaaaugugccacgugugucuacaacaugaugggaaagagagagaaaaaauuaggagaguucggaaaggcaaaaggaagucgcgcaauaugguacaugugguugggagcgcgcuuuuuagaguuugaagcccuugguuucaugaaugaagaucacugguucagcagagagaauucacucaguggaguggaaggagaaggacuccacaaacuuggauacauacucagagacauaucaaagauuccagggggaaauauguaugcagaugacacagccggaugggacacaagaauaacagaggaugaucuucagaaugaggccaaaaucacugacaucauggaaccugaacaugcccuauuggccacgucaaucuuuaagcuaaccuaccaaaacaagguaguaagggugcagagaccagcgaaaaauggaaccgugauggaugucauauccagacgugaccagagaggaaguggacagguuggaaccuauggcuuaaacaccuucaccaacauggaggcccaacuaauaagacaaauggagucugagggaaucuuuucacccagcgaauuggaaaccccaaaucuagccgaaagaguccucgacugguugaaaaaacauggcaccgagaggcugaaaagaauggcaaucaguggagaugacuguguggugaaaccaaucgaugacagauuugcaacagccuuaacagcuuugaaugacaugggaaagguaagaaaagacauaccgcaaugggaaccuucaaaaggauggaaugauuggcaacaagugccuuucuguucacaccauuuccaccagcugauuaugaaggaugggagggagauaguggugccaugccgcaaccaagaugaacuuguagguagggccagaguaucacaaggcgccggauggagcuugagagaaacugcaugccuaggcaagucauaugcacaaauguggcagcugauguacuuccacaggagagacuugagauuagcggcuaaugcuaucuguucagccguuccaguugauugggucccaaccagccgcaccaccuggucgauccaugcccaccaucaauggaugacaacagaagacauguugucaguguggaauaggguuuggauagaggaaaacccauggauggaggacaagacucauguguccaguugggaagacguuccauaccuaggaaaaagggaagaucaauggugugguucccuaauaggcuuaacagcacgagccaccugggccaccaacauacaaguggccauaaaccaagugagaaggcucauugggaaugagaauuaucuagacuucaugacaucaaugaagagauucaaaaacgagagugaucccgaaggggcacucugguaagccaacucauucacaaaauaaaggaaaauaaaaaaucaaacaaggcaagaagucaggccggauuaagccauagcacgguaagagcuaugcugccugugagccccguccaaggacguaaaaugaagucaggccgaaagccacgguucgagcaagccgugcugccuguagcuccaucguggggauguaaaaacccgggaggcugcaaaccauggaagcuguacgcaugggguagcagacuagugguuagaggagaccccucccaagacacaacgcagcagcggggcccaacaccaggggaagcuguacccuggugguaaggacuagagguuagaggagaccccccgcacaacaacaaacagcauauugacgcugggagagaccagagauccugcugucucuacagcaucauuccaggcacagaacgccaaaaaauggaauggugcuguugaaucaacagguucu

SEQ ID NO: 241 - RNA, 10723 nt, Dengue Virus
aguuguuagucuacguggaccgacaaagacagauucuuugagggagcuaagcucaacguaguucuaacaguuuuuuaauuagagagcagaucucugaugaauaaccaacggaaaaaggcgaaaaacacgccuuucaauaugcugaaacgcgagagaaaccgcgugucgacugugcaacagcugacaaagagauucucacuuggaaugcugcagggacgaggaccauuaaaacuguucauggcccugguggcguuccuucguuuccuaacaaucccaccaacagcagggauauugaagagauggggaacaauuaaaaaaucaaaagcuauuaauguuuugagaggguucaggaaagagauuggaaggaugcugaacaucuugaauaggagacgcagaucugcaggcaugaucauuaugcugauuccaacagugauggcguuccauuuaaccacacguaacggagaaccacacaugaucgucagcagacaagagaaagggaaaagucuucuguuuaaaacagaggauggcgugaacauguguacccucauggccauggaccuuggugaauugugugaagacacaaucacguacaaguguccccuucucaggcagaaugagccagaagacauagacuguuggugcaacucuacguccacguggguaacuuaugggacguguaccaccaugggagaacauagaagagaaaaaagaucaguggcacucguuccacaugugggaaugggacuggagacacgaacugaaacauggaugucaucagaaggggccuggaaacauguccagagaauugaaacuuggaucuugagacauccaggcuucaccaugauggcagcaauccuggcauacaccauaggaacgacacauuuccaaagagcccugauuuucaucuuacugacagcugucacuccuucaaugacaaugcguugcauaggaaugucaaauagagacuuuguggaagggguuucaggaggaagcuggguugacauagucuuagaacauggaagcugugugacgacgauggcaaaaaacaaaccaacauuggauuuugaacugauaaaaacagaagccaaacagccugccacccuaaggaaguacuguauagaggcaaagcuaaccaacacaacaacagaaucucgcugcccaacacaaggggaacccagccuaaaugaagagcaggacaaaagguucgucugcaaacacuccaugguagacagaggauggggaaauggauguggacuauuuggaaagggaggcauugugaccugugcuauguucagaugcaaaaagaacauggaaggaaaaguugugcaaccagaaaacuuggaauacaccauugugauaacaccucacucaggggaagagcaugcagucggaaaugacacaggaaaacauggcaaggaaaucaaaauaacaccacagaguuccaucacagaagcagaauugacagguuauggcacugucacaauggagugcucuccaagaacgggccucgacuucaaugagaugguguugcugcagauggaaaauaaagcuuggcuggugcacaggcaaugguuccuagaccugccguuaccaugguugcccggagcggacacacaagggucaaauuggauacagaaagagacauuggucacuuucaaaaauccccaugcgaagaaacaggauguuguuguuuuaggaucccaagaaggggccaugcacacagcacuuacaggggccacagaaauccaaaugucaucaggaaacuuacucuucacaggacaucucaagugcaggcugagaauggacaagcuacagcucaaaggaaugucauacucuaugugcacaggaaaguuuaaaguugugaaggaaauagcagaaacacaacauggaacaauaguuaucagagugcaauaugaaggggacggcucuccaugcaagaucccuuuugagauaauggauuuggaaaaaagacaugucuuaggucgccugauuacagucaacccaauugugacagaaaaagauagcccagucaacauagaagcagaaccuccauucggagacagcuacaucaucauaggaguagagccgggacaacugaagcucaacugguuuaagaaaggaaguucuaucggccaaauguuugagacaacaaugaggggggcgaagagaauggccauuuuaggugacacagccugggauuuuggauccuugggaggaguguuuacaucuauaggaaaggcucuccaccaagucuuuggagcaaucuauggagcugccuucagugggguuucauggacuaugaaaauccucauaggagucauuaucacauggauaggaaugaauucacgcagcaccucacugucugugacacuaguauuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcccaugaagagggcauuuguggaauccgcucaguaacaagacuggagaaucugauguggaaacaaauaacaccagaauugaaucacauucuaucagaaaaugaggugaaguuaacuauuaugacaggagacaucaaaggaaucaugcaggcaggaaaacgaucucugcggccucagcccacugagcugaaguauucauggaaaacauggggcaaagcaaaaaugcucucuacagagucucauaaccagaccuuucucauugauggccccgaaacagcagaaugccccaacacaaauagagcuuggaauucguuggaaguugaagacuauggcuuuggaguauucaccaccaauauauggcuaaaauugaaagaaaaacaggauguauucugcgacucaaaacucaugucagcggccauaaaagacaacagagccguccaugccgauauggguuauuggauagaaagugcacucaaugacacauggaagauagagaaagccucuuucauugaaguuaaaaacugccacuggccaaaaucacacacccucuggagcaauggagugcuagaaagugagaugauaauuccaaagaaucucgcuggaccagugucucaacacaacuauagaccaggcuaccauacacaaauaacaggaccauggcaucuagguaagcuugagauggacuuugauuucugugauggaacaacagugguagugacugaggacugcggaaauagaggacccucuuugagaacaaccacugccucuggaaaacucauaacagaauggugcugccgaucuugcacauuaccaccgcuaagauacagaggugaggaugggugcugguacgggauggaaaucagaccauugaaggagaaagaagagaauuuggucaacuccuuggucacagcuggacaugggcaggucgacaacuuuucacuaggagucuugggaauggcauuguuccuggaggaaaugcuuaggacccgaguaggaacgaaacaugcaauacuacuaguugcaguuucuuuugugacauugaucacagggaacauguccuuuagagaccugggaagagugaugguuaugguaggcgccacuaugacggaugacauagguaugggcgugacuuaucuugcccuacuagcagccuucaaagucagaccaacuuuugcagcuggacuacucuugagaaagcugaccuccaaggaauugaugaugacuacuauaggaauuguacuccucucccagagcaccauaccagagaccauucuugaguugacugaugcguuagccuuaggcaugaugguccucaaaauggugagaaauauggaaaaguaucaauuggcagugacuaucauggcuaucuugugcgucccaaacgcagugauauuacaaaacgcauggaaagugaguugcacaauauuggcagugguguccguuuccccacugcucuuaacauccucacagcaaaaaacagauuggauaccauuagcauugacgaucaaaggucucaauccaacagcuauuuuucuaacaacccucucaagaaccagcaagaaaaggagcuggccauuaaaugaggcuaucauggcagucgggauggugagcauuuuagccaguucucuccuaaaaaaugauauucccaugacaggaccauuaguggcuggagggcuccucacugugugcuacgugcucacuggacgaucggccgauuuggaacuggagagagcagccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuguaucaauaccaaucacggcagcagcaugguaccugugggaagugaagaaacaacgggccggaguauugugggauguuccuucacccccacccaugggaaaggcugaacuggaagauggagccuauagaauuaagcaaaaagggauucuuggauauucccagaucggagccggaguuuacaaagaaggaacauuccauacaauguggcaugucacacguggcgcuguucuaaugcauaaaggaaagaggauugaaccaucaugggcggacgucaagaaagaccuaauaucauauggaggaggcuggaaguuagaaggagaauggaaggaaggagaagaaguccagguauuggcacuggagccuggaaaaaauccaagagccguccaaacgaaaccuggucuuuucaaaaccaacgccggaacaauaggugcuguaucucuggacuuuucuccuggaacgucaggaucuccaauuaucgacaaaaaaggaaaaguugugggucuuuaugguaaugguguuguuacaaggaguggagcauaugugagugcuauagcccagacugaaaaaagcauugaagacaacccagagaucgaagaugacauuuuccgaaagagaagacugaccaucauggaccuccacccaggagcgggaaagacgaagagauaccuuccggccauagucagagaagcuauaaaacgggguuugagaacauuaaucuuggcccccacuagaguuguggcagcugaaauggaggaagcccuuagaggacuuccaauaagauaccagaccccagccaucagagcugagcacaccgggcgggagauuguggaccuaaugugucaugccacauuuaccaugaggcugcuaucaccaguuagagugccaaacuacaaccugauuaucauggacgaagcccauuucacagacccagcaaguauagcagcuagaggauacaucucaacucgaguggagaugggugaggcagcugggauuuuuaugacagccacucccccgggaagcagagacccauuuccucagagcaaugcaccaaucauagaugaagaaagagaaaucccugaacguucguggaauuccggacaugaaugggucacggauuuuaaagggaagacuguuugguucguuccaaguauaaaagcaggaaaugauauagcagcuugccugaggaaaaauggaaagaaagugauacaacucaguaggaagaccuuugauucugaguaugucaagacuagaaccaaugauugggacuucgugguuacaacugacauuucagaaaugggugccaauuucaaggcugagaggguuauagaccccagacgcugcaugaaaccagucauacuaacagauggugaagagcgggugauucuggcaggaccuaugccagugacccacucuagugcagcacaaagaagagggagaauaggaagaaauccaaaaaaugagaaugaccaguacauauacaugggggaaccucuggaaaaugaugaagacugugcacacuggaaagaagcuaaaaugcuccuagauaacaucaacacgccagaaggaaucauuccuagcauguucgaaccagagcgugaaaagguggaugccauugauggcgaauaccgcuugagaggagaagcaaggaaaaccuuuguagacuuaaugagaagaggagaccuaccagucugguuggccuacagaguggcagcugaaggcaucaacuacgcagacagaaggugguguuuugauggagucaagaacaaccaaauccuagaagaaaacguggaaguugaaaucuggacaaaagaaggggaaaggaagaaauugaaacccagaugguuggaugcuaggaucuauucugacccacuggcgcuaaaagaauuuaaggaauuugcagccggaagaaagucucugacccugaaccuaaucacagaaauggguaggcucccaaccuucaugacucagaaggcaagagacgcacuggacaacuuagcagugcugcacacggcugaggcagguggaagggcguacaaccaugcucucagugaacugccggagacccuggagacauugcuuuuacugacacuucuggcuacagucacgggagggaucuuuuuauucuugaugagcggaaggggcauagggaagaugacccugggaaugugcugcauaaucacggcuagcauccuccuaugguacgcacaaauacagccacacuggauagcagcuucaauaauacuggaguuuuuucucauaguuuugcuuauuccagaaccugaaaaacagagaacaccccaagacaaccaacugaccuacguugucauagccauccucacagugguggccgcaaccauggcaaacgagauggguuuccuagaaaaaacgaagaaagaucucggauugggaagcauugcaacccagcaacccgagagcaacauccuggacauagaucuacguccugcaucagcauggacgcuguaugccguggccacaacauuuguuacaccaauguugagacauagcauugaaaauuccucagugaaugugucccuaacagcuauagccaaccaagccacaguguuaaugggucucgggaaaggauggccauugucaaagauggacaucggaguuccccuucucgccauuggaugcuacucacaagucaaccccauaacucucacagcagcucuuuucuuauugguagcacauuaugccaucauagggccaggacuccaagcaaaagcaaccagagaagcucagaaaagagcagcggcgggcaucaugaaaaacccaacugucgauggaauaacagugauugaccuagauccaauaccuuaugauccaaaguuugaaaagcaguugggacaaguaaugcuccuaguccucugcgugacucaaguauugaugaugaggacuacaugggcucugugugaggcuuuaaccuuagcuaccgggcccaucuccacauugugggaaggaaauccagggagguuuuggaacacuaccauugcggugucaauggcuaacauuuuuagagggaguuacuuggccggagcuggacuucucuuuucuauuaugaagaacacaaccaacacaagaaggggaacuggcaacauaggagagacgcuuggagagaaauggaaaagccgauugaacgcauugggaaaaagugaauuccagaucuacaagaaaaguggaauccaggaaguggauagaaccuuagcaaaagaaggcauuaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaagaauguaagagaagucaaaggccuaacaaaaggaggaccaggacacgaagaacccauccccaugucaacauauggguggaaucuagugcgucuucaaaguggaguugacguuuucuucaucccgccagaaaagugugacacauuauugugugacauaggggagucaucaccaaaucccacaguggaagcaggacgaacacucagaguccuuaacuuaguagaaaauugguugaacaacaacacucaauuuugcauaaagguucucaacccauauaugcccucagucauagaaaaaauggaagcacuacaaaggaaauauggaggagccuuagugaggaauccacucucacgaaacuccacacaugagauguacuggguauccaaugcuuccgggaacauagugucaucagugaacaugauuucaaggauguugaucaacagauuuacaaugagauacaagaaagccacuuacgagccggauguugaccucggaagcggaacccguaacaucgggauugaaagugagauaccaaaccuagauauaauugggaaaagaauagaaaaaauaaagcaagagcaugaaacaucauggcacuaugaccaagaccacccauacaaaacgugggcauaccaugguagcuaugaaacaaaacagacuggaucagcaucauccauggucaacggaguggucaggcugcugacaaaaccuugggacgucguccccauggugacacagauggcaaugacagacacgacuccauuuggacaacagcgcguuuuuaaagagaaaguggacacgagaacccaagaaccgaaagaaggcacgaagaaacuaaugaaaauaacagcagaguggcuuuggaaagaauuagggaagaaaaagacacccaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugaaacauguguguacaacaugaugggaaaaagagagaagaagcuaggggaauucggcaaggcaaaaggcagcagagccauaugguacauguggcuuggagcacgcuucuuagaguuugaagcccuaggauucuuaaaugaagaucacugguucuccagagagaacucccugaguggaguggaaggagaagggcugcacaagcuagguuacauucuaagagacgugagcaagaaagagggaggagcaauguaugccgaugacaccgcaggaugggauacaagaaucacacuagaagaccuaaaaaaugaagaaaugguaacaaaccacauggaaggagaacacaagaaacuagccgaggccauuuucaaacuaacguaccaaaacaagguggugcgugugcaaagaccaacaccaagaggcacaguaauggacaucauaucgagaagagaccaaagagguaguggacaaguuggcaccuauggacucaauacuuucaccaauauggaagcccaacuaaucagacagauggagggagaaggagucuuuaaaagcauucagcaccuaacaaucacagaagaaaucgcugugcaaaacugguuagcaagaguggggcgcgaaagguuaucaagaauggccaucaguggagaugauuguguugugaaaccuuuagaugacagguucgcaagcgcuuuaacagcucuaaaugacaugggaaagauuaggaaagacauacaacaaugggaaccuucaagaggauggaaugauuggacacaagugcccuucuguucacaccauuuccaugaguuaaucaugaaagacggucgcguacucguuguuccauguagaaaccaagaugaacugauuggcagagcccgaaucucccaaggagcaggguggucuuugcgggagacggccuguuuggggaagucuuacgcccaaauguggagcuugauguacuuccacagacgcgaccucaggcuggcggcaaaugcuauuugcucggcaguaccaucacauuggguuccaacaagucgaacaaccugguccauacaugcuaaacaugaauggaugacaacggaagacaugcugacagucuggaacaggguguggauucaagaaaacccauggauggaagacaaaacuccaguggaaucaugggaggaaaucccauacuuggggaaaagagaagaccaauggugcggcucauugauuggguuaacaagcagggccaccugggcaaagaacauccaagcagcaauaaaucaaguuagaucccuuauaggcaaugaagaauacacagauuacaugccauccaugaaaagauucagaagagaagaggaagaagcaggaguucugugguagaaagcaaaacuaacaugaaacaaggcuagaagucaggucggauuaagccauaguacggaaaaaacuaugcuaccugugagccccguccaaggacguuaaaagaagucaggccaucauaaaugccauagcuugaguaaacuaugcagccuguagcuccaccugagaagguguaaaaaauccgggaggccacaaaccauggaagcuguacgcauggcguaguggacuagcgguuagaggagaccccucccuuacaaaucgcagcaacaaugggggcccaaggcgagaugaagcuguagucucgcuggaaggacuagagguuagaggagacccccccgaaacaaaaaacagcauauugacgcugggaaagaccagagauccugcugucuccucagcaucauuccaggcacagaacgccagaaaauggaauggugcuguugaaucaacagguucu

SEQ ID NO: 242 - RNA, 10707 nt, Dengue Virus
aguuguuagucuacguggaccgacaagaacaguuucgacucggaagcuugcuuaacguagugcugacaguuuuuuauuagagagcagaucucugaugaacaaccaacggaagaagacgggaaaaccgucuaucaauaugcugaaacgcgugagaaaccgugugucaacuggaucacaguuggcgaagagauucucaaaaggacugcugaacggccagggaccaaugaaauugguuauggcguucauagcuuuccucagauuucuagccauuccaccaacagcaggagucuuggcuagauggggaaccuucaagaagucgggggccauuaagguccugaaaggcuucaagaaggagaucucaaacaugcugagcauaaucaaccaacggaaaaagacaucgcucugucucaugaugauauugccagcagcacuugcuuuccacuugacuucacgagauggagagccgcgcaugauuguggggaagaaugaaagagguaaaucccuacuuuuuaagacagccucuggaaucaacaugugcacacucauagccauggauuugggagagaugugugaugacacggucacuuacaaaugcccccacauuaccgaaguggaaccugaagacauugacugcuggugcaaccuuacaucaacaugggugacuuauggaacgugcaaucaagcuggagagcauagacgcgacaagagaucaguggcguuagcuccccaugucggcaugggacuggacacacgcacccaaaccuggaugucggcugaaggagcuuggagacaagucgagaagguagagacaugggcccuuaggcacccaggguucaccauacuagcccuauuucucgcccauuacauaggcacuucccugacccagaaggugguuauuuucauauuauuaaugcuggucaccccauccaugacaaugagaugugugggaguaggaaacagagauuuuguggaagggcuaucaggagcuacguggguugacguggugcucgagcacggggggugugugacuaccauggcuaagaacaagcccacgcuggauauagagcuucagaagaccgaggccacccaacuggcgacccuaaggaagcuaugcauugaggggaaaauuaccaacauaacaacugacucaagauguccuacccaaggggaagcgguuuugccugaggagcaggaccagaacuacguguguaagcauacauacguagacagagguugggggaacgguugugguuuguuuggcaaaggaagcuugguaacaugugcgaaauuucaaugccuggaaccaauagagggaaaaguggugcaauaugagaaccucaaauacaccgucaucauuacagugcacacaggagaccaacaccaggugggaaaugaaacgcaaggagucacggcugagauaacaccucaggcaucaaccacugaagccaucuugccugaauauggaacccuugggcuagaaugcucaccacggacagguuuggauuucaaugaaaugaucuuacuaacaaugaagaacaaagcauggaugguacauagacaaugguucuuugaccuaccucuaccaugggcaucaggagcuacaacagaaacaccaaccuggaacaggaaggagcuucuugugacauucaaaaacgcacaugcgaaaaaacaagaaguaguuguccuuggaucgcaagagggagcaaugcauaccgcacugacaggagcuacagaaauccaaaacucaggaggcacaagcauuuucgcggggcacuuaaaauguagacuuaagauggacaaauuggaacucaaggggaugagcuaugcaaugugcacgaauaccuuuguguugaagaaagaagucucagaaacgcagcacgggacaauacucauuaagguugaguacaaaggggaagaugcaccuugcaagauucccuuuuccacagaggauggacaagggaaagcucauaauggcagacugaucacagccaacccuguggugacuaagaaggaggagccugucaauauugaggcugaaccuccuuuuggggaaagcaauauaguaauuggaauuggagacaacgccuugaaaaucaacugguacaagaaggggagcucgauugggaagauguucgaggccacugaaaggggugcaaggcgcauggccaucuugggagacacagcuugggacuuuggaucagugggugguguucugaacucauuaggcaaaauggugcaccaaauauuuggaagugcuuauacagcccuguucaguggagucucuugggugaugaaaauuggaauagguguccucuugacuuggauaggguugaauucaaaaaacacauccaugucauuuucaugcauugcgauaggaaucauuacacucuaucugggagcugugguacaagcugacauggggugugucauaaacuggaagggcaaagaacucaaauguggaagcggaauuuucgucaccaaugagguccauaccuggacagagcaauacaaauuccaagcagacuccccaaaaagauuggcaacagccauugcaggcgccugggagaauggaguguguggaauuaggucaacaaccagaauggagaaucucuuguggaagcaaauagccaaugaacugaacuacauauuaugggaaaacaauaucaaauuaacgguaguugugggcgauacacuuggggucuuagagcaagggaaaagaacacuaacaccacaacccauggagcuaaaauacucauggaaaacguggggaaaggcaaaaauagugacagcugaaacacaaaauuccucuuucauaauagacgggccaaacacaccggaguguccaagugccucaagagcauggaaugugugggagguggaagauuacggguucggagucuucacaaccaacauauggcugaaacuccgagaggucuacacccaacuaugugaccauaggcuaaugucggcagcugucaaggaugagagggccgugcaugccgacaugggcuacuggauagaaagccaaaagaauggaaguuggaagcuagaaaaagcaucccucauagagguaaaaaccugcacauggccaaaaucacacacucucuggacuaauggugugcuagagagugacaugaucaucccaaagagucuagcugguccuaucucacaacacaacuacaggcccggguaccacacccaaacggcaggacccuggcacuuaggaaaauuggagcuggacuucaacuacugugaaggaacaacaguugucaucacagaaagcugugggacaagaggcccaucauugagaacaacaacagugucagggaaguugauacacgaaugguguugccgcucgugcacacuucccccccugcgauacaugggagaagacggcugcugguauggcauggaaaucagacccaucagugagaaagaagagaacaugguaaagucuuuagucucagcgggaaguggaaagguggacaacuucacaaugggugucuuguguuuggcaauccucuuugaagagguguugagaggaaaauuugggaagaaacacaugauugcagggguuuucuuuacguuugugcuccuucucucagggcaaauaacauggagagacauggcgcacacacuaauaaugaucggguccaacgccucugacaggaugggaaugggcgucaccuaccuagcucuaauugcaacauuuaaaauccagccauucuuggcuuugggauuuuuccuaagaaagcugacaucuagagaaaauuuauuguuaggaguuggguuggccauggcaacaacguuacaacugccagaggacauugaacaaauggcaaauggagucgcucuggggcucauggcucuuaaacugauaacacaauuugaaacauaccaauuguggacggcauuagucuccuuaacguguucaaacacaauuuuuacguugacuguugccuggagaacagccacucugauuuuggccggaguuucgcuuuuaccagugugccagucuucaagcaugaggaaaacagauuggcucccaaugacaguggcagcuaugggaguuccaccccuuccacuuuuuauuuuuagcuugaaagacacacucaaaaggagaagcuggccacugaaugaaggggugauggcuguugggcuugugagcauucuggccaguucucuccuuagaaaugaugugcccauggcuggaccauuaguggccgggggcuugcugauagcgugcuacgucauaacuggcacgucagcggaccucacuguagaaaaagccccagauguaacaugggaggaagaggcugagcagacaggagugucccacaacuuaaugaucacaguugaugaugauggaacaaugagaauaaaagaugaugagacugagaacauccuaacagugcuuuuaaaaacagcauuacuaauaguaucaggcauuuuuccauacuccauacccgcaacauuguuggucuggcacacuuggcaaaaacaaacccaaagauccggcguuuuaugggacguacccagccccccagagacacagaaagcagaacuggaagaagggguuuauaggaucaaacagcaaggaauuuuugggaaaacccaaguagggguuggaguacagaaagaaggagucuuccacaccauguggcacgucacaagaggggcaguguugacacauaaugggaaaagacuggaaccaaacugggcuagugugaaaaaagaucugauuucauauggaggaggauggagacugagcgcacaauggcaaaagggggaggaggugcagguuauugccguagagccagggaagaacccaaagaacuuucaaaccacgccaggcacuuuccagacuacuacaggggaaauaggagcaauugcacuggauuucaagccuggaacuucaggaucuccuaucauaaauagagagggaaagguagugggacuguauggcaauggagugguuacaaagaaugguggcuaugucagcggaauagcgcaaacaaaugcagaaccagauggaccgacaccagaguuggaagaagagauguucaaaaagcgaaaccugaccauaauggaucuucauccugggucaggaaagacacggaaauaccuuccagcuauugucagagaggcaaucaagagacguuuaagaaccuuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcguuugcugucaccaguuaggguuccaaauuacaacuugauaauaauggaugaggcccauuucacagacccagccaguauagcggcuagaggguacauaucaacucguguuggaaugggagaggcagccgcaaucuucaugacagcaacacccccuggaacagcugaugccuuuccucagagcaacgcuccaauucaagaugaagaaagggacauaccagaacgcucauggaauucaggcaaugaauggauuaccgacuucgcugggaaaacggugugguuugucccuagcauuaaagccggaaaugacauagcaaacugcuugcgaaaaaacgggaaaaaagucauucaacuuaguaggaagacuuuugacacagaauaucagaagacuaaacugaaugauugggacuuuguggugacaacugacauuucagaaaugggggccaauuucaaagcagauagagugaucgacccaagaagaugucucaaaccagugaucuugacagauggaccagagcgggugauccuggccggaccaaugccagucaccgcggcgagugcugcgcaaaggagagggagaguuggcaggaacccacaaaaagagaaugaccaguacauauucacgggccagccucucaacaaugaugaagaccaugcucacuggacagaagcaaaaaugcugcuggacaacaucaacacaccagaagggauuauaccagcucucuuugaaccagaaagggagaagucagccgccauagacggugaguaucgccugaagggugaguccaggaagacuuucguggaacucaugaggaggggugaccuuccaguuugguuagcccauaaaguagcaucagaaggaaucaaauacacagauagaaaauggugcuuugaugggcaacgcaauaaucaaauuuuagaggagaacauggauguggaaauuuggacaaaggaaggagaaaagaaaaaauugagaccuagguggcuugaugcccgcacuuauucagauccauuggcacucaaggaauucaaggacuuugcggcuggcagaaagucaaucgcccuugaucuugugacagaaauaggaagagugccuucacaucuagcccacagaacaagaaacgcucuggacaaucuggugaugcugcauacgucagaagauggcgguagggcuuacaggcaugcgguggaggaacuaccagaaacaauggaaacacuccuacucuugggacuaaugaucuuguugacagguggagcaaugcuuuucuugauaucagguaaagggauuggaaagacuucaauaggacucauuuguguaaucgcuuccagcggcauguuguggauggccgaaguuccacuccaauggaucgcgucggcuauaguccuggaguuuuuuaugaugguguugcucauaccagaaccagaaaagcagagaaccccccaagacaaccaacucgcauaugucgugauaggcauacuuacauuggcugcaacaauagcagccaaugaaaugggacugcuggaaaccacaaagagagacuuaggaaugucuaaggagccagguguuguuucuccaaccagcuauuuggauguggacuugcacccagcaucagccuggacauuguacgccguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggcgugccacuacuggcacuggguugcuauucacaagugaacccacugacucuaacugcggcaguacuuuugcuaaucacacauuaugcuaucauagguccaggauugcaagcaaaagccacccgugaagcucagaaaaggacagcugcuggaauaaugaagaauccaacaguggaugggauaaugacaauagaccuagauucuguaauauuugauucaaaauuugaaaaacaacugggacagguuaugcuccugguuuugugcgcaguccaacucuugcuaaugagaacaucaugggccuugugugaagcuuuaacucuagcuacaggaccaauaacaacacucugggaaggaucaccugguaaguucuggaacaccacgauagcuguuuccauggcgaacauuuuuagagggagcuauuuagcaggagcugggcuugcuuuuucuauuaugaaaucaguuggaacaggaaaaagaggaacaggcucacaaggugaaacuuuaggagaaaaauggaaaaagaaauuaaaucaauuaucccggaaagaguuugaccuuuacaagaaaucuggaaucacugaaguggauagaacagaagccaaagaaggguugaaaagaggagagacaacacaucaugccgugucccgagguagcgcaaaacuucaaugguuuguggaaagaaacauggucguucccgaaggaagagucauagacuugggcuguggaagaggaggcuggucauauuacugugcaggacugaaaaaagucacagaagugcgaggauacacaaaaggcgguccaggacacgaagaaccaguaccuaugucuacauauggauggaacauaguuaaguuaaugagcggaaaggauguguucuaucucccaccugaaaagugugauacccuguugugugacauuggagaaucuucaccaagcccaacaguggaagagagcagaacuauaagaguuuugaagaugguugaaccauggcuaaaaaacaaccaguuuugcauuaaaguuuugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucucuucagucaacauggugucuagauugcuacugaacagguucacgaugacacacaggagacccaccauagagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggauccuaugaagucaaagccacaggcucagccuccuccaugauaaauggagucgugaaacuccucaccaaaccaugggauguggugcccauggugacacagauggcaaugacagacacaacuccauuuggccagcagagagucuuuaaagagaaaguggacaccaggacgcccaggcccaugccagggacaagaaaggcuauggagaucacagcggaguggcucuggagaacccugggaaggaacaaaagacccagauuaugcacaagggaagaguuuacaaaaaaggucagaacuaacgcagccaugggcgccguuuucacagaggagaaccaaugggacagugcgaaagcugcuguugaggaugaagaauuuuggaaacuuguggacagagaacgugaacuccacaaauugggcaaauguggaagcugcguuuauaacaugaugggcaagagagagaaaaaacuuggagaguuuggcaaagcaaaaggcaguagagcuauaugguacaugugguugggagccagguaccuugaguucgaagcccuuggauucuuaaaugaagaccacugguucucgcgugaaaacucuuacaguggaguagaaggagaaggacugcacaagcuaggcuacauauuaagggacauuuccaagauacccggaggagccauguaugcugaugacacagcugguugggacacaagaauaacagaagaugaccugcacaaugaggaaaagaucauacagcaaauggacccugaacacaggcaguuagcgaacgcuauauucaagcucacauaccaaaacaaaguggucaaaguucaacgaccgacuccaacgggcacgguaauggauauuauaucuaggaaagaccaaaggggcaguggacaacugggaacuuauggccugaauacauucaccaacauggaagcccaguuagucagacaaauggaaggagaaggugugcugacaaaggcagaccucgagaacccucaucugcuagagaagaaaaucacacaaugguuggaaaccaaaggaguggagagguuaaaaagaauggccauuagcggggaugauugcguggugaaaccaaucgaugacagguucgcuaaugcccugcuugcuuugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaacugcaugucuggggaaagccuacgcccaaauguggagucucauguauuuucacagaagagaucucagauuagcauccaacgccauauguucagcaguaccaguccacuggguucccacaaguagaacgacauggucuauucaugcucaccaucaguggaugacuacagaagacaugcuuacuguuuggaacaggguguggauagaggaaaauccauggauggaagacaaaacuccaguuacaacuugggaaaauguuccauaucuaggaaagagagaagaccaaugguguggaucacuuauuggucucacuuccagagcaaccugggcccagaacauacccacagcaauucaacaggugagaagccuuauaggcaaugaagaguuccuggacuacaugccuucaaugaagagauucaggaaggaagaggagucggagggagccauuugguaaacguaggaaguggaaaagaggcuaacugucaggccaccuuaagccacaguacggaagaagcugugcugccugugagccccguccaaggacguuaaaagaagaagucaggccccaaagccacgguuugagcaaaccgugcugccuguagcuccgucguggggacguaaaaccugggaggcugcaaacuguggaagcuguacgcacgguguagcagacuagcgguuagaggagaccccucccaugacacaacgcagcagcggggcccgagcacugagggaagcuguaccuccuugcaaaggacuagagguuagaggagaccccccgcaaauaaaaacagcauauugacgcugggagagaccagagauccugcugucuccucagcaucauuccaggcacagaacgccagaaaauggaauggugcuguugaaucaacagguucu

SEQ ID NO: 243 - RNA, 10649 nt, Dengue Virus
aguuguuagucuguguggaccgacaaggacaguuccaaaucggaagcuugcuuaacacaguucuaacaguuuguuugaauagagagcagaucucuggaaaaaugaaccaacgaaaaaaggugguuagaccaccuuucaauaugcugaaacgcgagagaaaccgcguaucaaccccucaaggguuggugaagagauucucaaccggacuuuuuucugggaaaggacccuuacggauggugcuagcauucaucacguuuuugcgaguccuuuccaucccaccaacagcagggauucugaagagauggggacaguugaagaaaaauaaggccaucaagauacugauuggauucaggaaggagauaggccgcaugcugaacaucuugaacgggagaaaaaggucaacgauaacauugcugugcuugauucccaccguaauggcguuuucccucagcacaagagauggcgaaccccucaugauaguggcaaaacaugaaagggggagaccucucuuguuuaagacaacagaggggaucaacaaaugcacucucauugccauggacuugggugaaaugugugaggacacugucacguauaaaugcccccuacuggucaauaccgaaccugaagacauugauugcuggugcaaccucacgucuaccugggucauguaugggacaugcacccagagcggagaacggagacgagagaagcgcucaguagcuuuaacaccacauucaggaaugggauuggaaacaagagcugagacauggaugucaucggaaggggcuuggaagcaugcucagagaguagagagcuggauacucagaaacccaggauucgcgcucuuggcaggauuuauggcuuauaugauugggcaaacaggaauccagcgaacugucuucuuuguccuaaugaugcuggucgccccauccuacggaaugcgaugcguaggaguaggaaacagagacuuuguggaaggagucucagguggagcaugggucgaccuggugcuagaacauggaggaugcgucacaaccauggcccagggaaaaccaaccuuggauuuugaacugacuaagacaacagccaaggaaguggcucuguuaagaaccuauugcauugaagccucaauaucaaacauaacuacggcaacaagauguccaacgcaaggagagccuuaucugaaagaggaacaggaccaacaguacauuugccggagagaugugguagacagaggguggggcaauggcuguggcuuguuuggaaaaggaggaguugugacaugugcgaaguuuucauguucggggaagauaacaggcaauuugguccaaauugagaaccuugaauacacagugguuguaacaguccacaauggagacacccaugcaguaggaaaugacacauccaaucauggaguuacagccaugauaacucccaggucaccaucgguggaagucaaauugccggacuauggagaacuaacacucgauugugaacccaggucuggaauugacuuuaaugagaugauucugaugaaaaugaaaaagaaaacauggcucgugcauaagcaaugguuuuuggaucugccucuuccauggacagcaggagcagacacaucagagguucacuggaauuacaaagagagaauggugacauuuaagguuccucaugccaagagacaggaugugacagugcugggaucucaggaaggagccaugcauucugcccucgcuggagccacagaaguggacuccggugauggaaaucacauguuugcaggacaucuuaagugcaaaguccguauggagaaauugagaaucaagggaaugucauacacgauguguucaggaaaguuuucaauugacaaagagauggcagaaacacagcaugggacaacaguggugaaagucaaguaugaaggugcuggagcuccguguaaaguccccauagagauaagagauguaaacaaggaaaaagugguugggcguaucaucucauccaccccuuuggcugagaauaccaacaguguaaccaacauagaauuagaaccccccuuuggggacagcuacauagugauagguguuggaaacagcgcauuaacacuccauugguucaggaaagggaguuccauuggcaagauguuugaguccacauacagaggugcaaaacgaauggccauucuaggugaaacagcuugggauuuugguuccguugguggacuguucacaucauugggaaaggcugugcaccagguuuuuggaaguguguauacaaccauguuuggaggagucucauggaugauuagaauccuaauuggguucuuaguguuguggauuggcacgaacucgaggaacacuucaauggcuaugacgugcauagcuguuggaggaaucacucuguuucugggcuucacaguucaagcagacauggguuguguggcgucauggagugggaaagaauugaaguguggaagcggaauuuuugugguugacaacgugcacacuuggacagaacaguacaaauuucaaccagaguccccagcgagacuagcgucugcaauauuaaaugcccacaaagauggggucuguggaauuagaucaaccacgaggcuggaaaaugucauguggaagcaaauaaccaacgagcuaaacuauguucucugggaaggaggacaugaccucacuguaguggcuggggaugugaaggggguguugaccaaaggcaagagagcacucacacccccagugagugaucugaaauauucauggaagacauggggaaaagcaaaaaucuucaccccagaagcaagaaauagcacauuuuuaauagacggaccagacaccucugaaugccccaaugaacgaagagcauggaacucucuugagguggaagacuauggauuuggcauguucacgaccaacauauggaugaaauuccgagaaggaaguucagaagugugugaccacagguuaaugucagcugcaauuaaagaucagaaagcugugcaugcugacauggguuauuggauagagagcucaaaaaaccagaccuggcagauagagaaagcaucucuuauugaagugaaaacaugucuguggcccaagacccacacacuguggagcaauggagugcuggaaagccagaugcucauuccaaaaucauaugcgggcccuuuuucacagcacaauuaccgccagggcuaugccacgcaaaccgugggcccauggcacuuaggcaaauuagagauagacuuuggagaaugccccggaacaacagucacaauucaggaggauugugaccauagaggcccaucuuugaggaccaccacugcaucuggaaaacuagucacgcaauggugcugccgcuccugcacgaugccucccuuaagguucuugggagaagaugggugcugguaugggauggagauuaggcccuugagugaaaaagaagagaacauggucaaaucacaggugacggccggacagggcacaucagaaacuuuuucuaugggucuguugugccugaccuuguuuguggaagaaugcuugaggagaagagucacuaggaaacacaugauauuaguuguggugaucacucuuugugcuaucauccugggaggccucacauggauggacuuacuacgagcccucaucauguugggggacacuaugucugguagaauaggaggacagauccaccuagccaucauggcaguguucaagaugucaccaggauacgugcuggguguguuuuuaaggaaacucacuucaagagagacagcacuaaugguaauaggaauggccaugacaacggugcuuucaauuccacaugaccuuauggaacucauugauggaauaucacugggacuaauuuugcuaaaaauaguaacacaguuugacaacacccaagugggaaccuuagcucuuuccuugacuuucauaagaucaacaaugccauuggucauggcuuggaggaccauuauggcuguguuguuuguggucacacucauuccuuugugcaggacaagcugucuucaaaaacagucucauuggguagaaauaacagcacucauccuaggagcccaagcucugccaguguaccuaaugacucuuaugaaaggagccucaagaagaucuuggccucuuaacgagggcauaauggcuguggguuugguuagucucuuaggaagcgcucuuuuaaagaaugaugucccuuuagcuggcccaaugguggcaggaggcuuacuucuggcggcuuacgugaugagugguagcucagcagaucugucacuagagaaggccgccaacgugcagugggaugaaauggcagacauaacaggcucaagcccaaucguagaagugaagcaggaugaagauggcucuuucuccauacgggacgucgaggaaaccaauaugauaacccuuuuggugaaacuggcacugauaacagugucaggucucuaccccuuggcaauuccagucacaaugaccuuaugguacauguggcaagugaaaacacaaagaucaggagcccugugggacguccccucacccgcugccacuaaaaaagccgcacugucugaaggaguguacaggaucaugcaaagaggguuauucgggaaaacucagguuggaguagggauacacauggaagguguauuucacacaauguggcauguaacaagaggaucagugaucugccacgagacugggagauuggagccaucuugggcugacgucaggaaugacaugauaucauacggugggggauggaggcuuggagacaaaugggacaaagaagaagacguucagguccucgccauagaaccaggaaaaaauccuaaacauguccaaacgaaaccuggccuuuucaagacccuaacuggagaaauuggagcaguaacauuagauuucaaacccggaacgucugguucucccaucaucaacaggaaaggaaaagucaucggacucuauggaaauggaguaguuaccaaaucaggugauuacgucagugccauaacgcaagccgaaagaauuggagagccagauuaugaaguggaugaggacauuuuucgaaagaaaagauuaacuauaauggacuuacaccccggagcuggaaagacaaaaagaauucuuccaucaauagugagagaagccuuaaaaaggaggcuacgaacuuugauuuuagcucccacgagagugguggcggccgagauggaagaggcccuacguggacugccaauccguuaucagaccccagcugugaaaucagaacacacaggaagagagauuguagaccucaugugucaugcaaccuucacaacaagacuuuugucaucaaccaggguuccaaauuacaaccuuauagugauggaugaagcacauuucaccgauccuucuagugucgcggcuagaggauacaucucgaccaggguggaaaugggagaggcagcagccaucuucaugaccgcaaccccucccggagcgacagaucccuuuccccagagcaacagcccaauagaagacaucgagagggaaauuccggaaaggucauggaacacaggguucgacuggauaacagacuaccaagggaaaacugugugguuuguucccagcauaaaagcuggaaaugacauugcaaauuguuugagaaagucgggaaagaaaguuauccaguugaguaggaaaaccuuugauacagaguauccaaaaacgaaacucacggacugggacuuuguggucacuacagacauaucugaaaugggggccaauuuuagagccgggagagugauagacccuagaagaugccucaagccaguuauccuaccagaugggccagagagagucauuuuagcagguccuauuccagugacuccagcaagcgcugcucagagaagagggcgaauaggaaggaacccagcacaagaagacgaccaauacguuuucuccggagacccacuaaaaaaugaugaagaucaugcccacuggacagaagcaaagaugcugcuugacaauaucuacaccccagaagggaucauuccaacauuguuugguccggaaagggaaaaaacccaagccauugauggagaguuucgccucagaggggaacaaaggaagacuuuuguggaauuaaugaggagaggagaccuuccgguguggcugagcuauaagguagcuucugcuggcauuucuuacgaagaucgggaauggugcuucacaggggaaagaaauaaccaaauuuuagaagaaaacauggagguugaaauuuggacuagagagggagaaaagaaaaagcuaaggccaagaugguuagaugcacguguauacgcugaccccauggcuuugaaggauuucaaggaguuugccaguggaaggaagaguauaacucucgacauccuaacagagauugccaguuugccaacuuaccuuuccucuagggccaagcucgcccuugauaacauagucaugcuccacacaacagaaagaggagggagggccuaucaacacgcccugaacgaacuuccggagucacuggaaacacucaugcuuguagcuuuacuaggugcuaugacagcaggcaucuuccuguuuuucaugcaagggaaaggaauagggaaauugucaauggguuugauaaccauugcgguggcuaguggcuugcucuggguagcagaaauucaaccccaguggauagcggccucaaucauacuagaguuuuuucucaugguacuguugauaccggaaccagaaaaacaaaggaccccacaagacaaucaauugaucuacgucauauugaccauucucaccaucauuggucuaauagcagccaacgagauggggcugauugaaaaaacaaaaacggauuuuggguuuuaccagguaaaaacagaaaccaccauccucgauguggacuugagaccagcuucagcauggacgcucuaugcaguagccaccacaauucugacucccaugcugagacacaccauagaaaacacgucggccaaccuaucucuagcagccauugccaaccaggcagccguccuaauggggcuuggaaaaggauggccgcuccacagaauggaccucggugugccgcuguuagcaaugggaugcuauucucaagugaacccaacaaccuugacagcauccuuagucaugcuuuuaguccauuaugcaauaauaggcccaggauugcaggcaaaagccacaagagaggcccagaaaaggacagcugcugggaucaugaaaaaucccacaguggacgggauaacaguaauagaucuagaaccaauauccuaugacccaaaauuugaaaagcaauuagggcaggucaugcuacuagucuugugugcuggacaacuacucuugaugagaacaacaugggcuuucugugaagucuugacuuuggccacaggaccaaucuugaccuugugggagggcaacccgggaagguuuuggaacacgaccauagccguauccaccgccaacauuuucaggggaaguuacuuggcgggagcuggacuggcuuuuucacucauaaagaaugcacaaaccccuaggaggggaacugggaccacaggagagacacugggagagaaguggaagagacagcuaaacucauuagacagaaaagaguuugaagaguauaaaagaaguggaauacuagaaguggacaggacugaagccaagucugcccugaaagaugggucuaaaaucaagcaugcaguaucaagaggguccaguaagaucagauggauuguugagagagggaugguaaagccaaaagggaaaguuguagaucuuggcugugggagaggaggauggucuuauuacauggcgacacucaagaacgugacugaagugaaaggguauacaaaaggagguccaggacaugaagaaccgauucccauggcuacuuaugguuggaauuuggucaaacuccauucagggguugacguguucuacaaacccacagagcaaguggacacccugcucugugauauuggggagucaucuucuaauccaacaauagaggaaggaagaacauuaagaguuuugaagaugguggagccauggcucucuucaaaaccugaauucugcaucaaaguccuuaaccccuacaugccaacagucauagaagagcuggagaaacugcagagaaaacauggugggaaccuugucagaugcccgcuguccaggaacuccacccaugagauguauugggugucaggagcgucgggaaacauugugagcucugugaacacaacaucaaagauguuguugaacagguucacaacaaggcauaggaaacccacuuaugagaaggacguagaucuuggggcaggaacgagaagugucuccacugaaacagaaaaaccagacaugacaaucauugggagaaggcuucagcgauugcaagaagagcacaaagaaaccuggcauuaugaucaggaaaacccauacagaaccugggcguaucauggaagcuaugaagcuccuucgacaggcucugcauccuccauggugaacggggugguaaaacugcuaacaaaacccugggaugugauuccaauggugacucaguuagccaugacagauacaaccccuuuugggcaacaaagaguguucaaagagaagguggauaccagaacaccacaaccaaaacccgguacacgaaugguuaugaccacgacagccaauuggcugugggcccuccuuggaaagaagaaaaaucccagacugugcacaagggaagaguucaucucaaaaguuagaucaaacgcagccauaggcgcagucuuucaggaagaacagggauggacaucagccagugaagcugugaaugacagccgguuuugggaacugguugacaaagaaagggcccuacaccaggaagggaaaugugaaucgugugucuauaacaugaugggaaaacgugagaaaaaguuaggagaguuuggcagagccaagggaagccgagcaaucugguacauguggcugggagcgcgguuucuggaauuugaagcccuggguuuuuugaaugaagaucacugguuuggcagagaaaauucauggaguggaguggaaggggaaggucugcacagauugggauauauccuggaggagauagacaagaaggauggagaccuaauguaugcugaugacacagcaggcugggacacaagaaucacugaggaugaccuucaaaaugaggaacugaucacggaacagauggcuccccaccacaagauccuagccaaagccauuuucaaacuaaccuaucaaaacaaaguggugaaaguccucagacccacaccgcggggagcggugauggauaucauauccaggaaagaccaaagagguaguggacaaguuggaacauaugguuugaacacauucaccaacauggaaguucaacucauccgccaaauggaagcugaaggagucaucacacaagaugacaugcagaacccaaaaggguugaaagaaagaguugagaaauggcugaaagaguguggugucgacagguuaaagaggauggcaaucaguggagacgauugcguggugaagccccuagaugagagguuuggcacuucccuccucuucuugaacgacaugggaaaggugaggaaagacauuccgcagugggaaccaucuaagggauggaaaaacuggcaagagguuccuuuuugcucccaccacuuucacaagaucuuuaugaaggauggccgcucacuaguuguuccauguagaaaccaggaugaacugauagggagagccagaaucucgcagggagcuggauggagcuuaagagaaacagccugccugggcaaagcuuacgcccagauguggucgcuuauguacuuccacagaagggaucugcguuuagccuccauggccauaugcucagcaguuccaacggaaugguuuccaacaagcagaacaacauggucaauccacgcucaucaccaguggaugaccacugaagauaugcucaaaguguggaacagaguguggauagaagacaacccuaauaugacugacaagacuccaguccauucgugggaagauauaccuuaccuagggaaaagagaggauuugugguguggaucccugauuggacuuucuuccagagccaccugggcgaagaacauucauacggccauaacccaggucaggaaccugaucggaaaagaggaauacguggauuacaugccaguaaugaaaagauacagugcuccuucagagagugaaggaguucuguaauuaccaacaacaaacaccaaaggcuauugaagucaggccacuugugccacgguuugagcaaaccgugcugccuguagcuccgccaauaaugggaggcguaauaauccccagggaggccaugcgccacggaagcuguacgcguggcauauuggacuagcgguuagaggagaccccucccaucacugauaaaacgcagcaaaagggggcccgaagccaggaggaagcuguacuccugguggaaggacuagagguuagaggagacccccccaacacaaaaacagcauauugacgcugggaaagaccagagauccugcugucucugcaacaucaauccaggcacagagcgccgcaagauggauugguguuguugauccaacagguucu

SEQ ID NO: 244 - RNA, 2049 nt, Artificial Sequence
  Synthetic Polynucleotide
auggaugcuaugaaaagaggccuguguuguguguugcuguugugcggagcuguguuugugucaccuuuccaccugacuacccgcaauggugagccccauaugauugugucgcgccaggagaaggggaagucccuccuguucaaaacugaaaacggcgugaacauguguacccugauggccauggaccuuggagaacugugcgaggacaccaucaccuacaauuguccgcuccugcgccaaaacgaaccagaagauaucgacugcuggugcaauuccacuucaaccuggguuaccuacggaacuugcaccgccacgggagaacacagaagagaaaagcgcucgguggcgcuggugccucaugucggaaugggacuggagacucggacggagacuuggauguccucggagggagcauggaaacaugcccaacggaucgaaacuugggugcugaggcacccuggauucaccaucauggcagcgauccucgccuacacuauagguacuaccuacuuucaaagggugcugaucuucauucuccucaccgcaguggccccuucaaugaccaugaggugcauugggaucucgaaccgggacuucgucgaaggaguguccggagguagcugggucgacaucguccuggaacacggaagcugcgugacuacuauggcgaagaacaagccaaccuuggacuucgagcuuaucaagaccgaggcgaagcacccggccacucugagaaaguacugcaucgaggcuaagcucaccaacacgaccacugccucgcgaugcccaacucagggagaaccgucacugaacgaagaacaggauaaacgcuuugugugcaagcauagcaugguggauagaggcuggggaaacggcuguggacucuucggaaaggguggaauugugacgugcgcaauguucacuugcaagaagaauauggaagggaagaucguccagccggagaaccuggaauacacuaucgugaucaccccgcacucaggcgaggagaacgcagugggcaacgauaccgggaagcacgggaaggaaaucaaggugaccccgcagucguccauuaccgaggccgaacucaccggauacggcacugugacuauggaaugcucgccacggaccgggcuggauuucaaugagauggugcucuugcaaauggagaacaaagccuggcugguccaccgccagugguuccucgaccucccccuuccguggcugccgggagcugacacccaaggauccaacuggauccaaaaagaaacccuugucacguuuaagaauccacaugccaaaaagcaggacguggucgugcucggaagccaggaaggagccaugcacacugcgcugacuggagcaaccgaaauucaaaugucgagcggcaaccuccucuucacuggacaucugaagugccggcugcgcauggacaaacugcaacuuaagggcaugucauacucgauguguaccggcaaauucaagguggugaaggagaucgcggagacucagcacgggaccaucgucauccggguccaguaugagggugaugguucccccugcaagaucccuuucgaaaucauggaucuggagaaacgucacgugcugggccggcugaucacugugaauccgaucguuacggagaaagacagcccggugaacaucgaagcugaaccgccguuuggggauagcuacauuaucaucggcguggaaccaggccagcucaaguugucgugguucaagaaaggauccagcaucggacagauguucgaaaccacuaugcgcggagccaaacgcauggcuauccugggggacacggccugggacuucgggucgcugggugguguguucaccuccauuggaaaggcgcuccaucagguguuuggugcgaucuacggcgccgcauucuccggagugucauggaccaugaagauccucaucggagucgucaucaccuggaucggcaugaauucucgguccacuuccuugagcgucagccuggugcuggucggaguugugacucuguaccuuggagugaugguccaggcc

SEQ ID NO: 245 - RNA, 1749 nt, Artificial Sequence
  Synthetic Polynucleotide
auggaugcuaugaaaagaggccuguguuguguguugcuguugugcggagcuguguuugugucaccuuuccaccugacuacccgcaauggugagccccauaugauugugucgcgccaggagaaggggaagucccuccuguucaaaacugaaaacggcgugaacauguguacccugauggccauggaccuuggagaacugugcgaggacaccaucaccuacaauuguccgcuccugcgccaaaacgaaccagaagauaucgacugcuggugcaauuccacuucaaccuggguuaccuacggaacuugcaccgccacgggagaacacagaagagaaaagcgcucgguggcgcuggugccucaugucggaaugggacuggagacucggacggagacuuggauguccucggagggagcauggaaacaugcccaacggaucgaaacuugggugcugaggcacccuggauucaccaucauggcagcgauccucgccuacacuauagguacuaccuacuuucaaagggugcugaucuucauucuccucaccgcaguggccccuucaaugaccaugaggugcauugggaucucgaaccgggacuucgucgaaggaguguccggagguagcugggucgacaucguccuggaacacggaagcugcgugacuacuauggcgaagaacaagccaaccuuggacuucgagcuuaucaagaccgaggcgaagcacccggccacucugagaaaguacugcaucgaggcuaagcucaccaacacgaccacugccucgcgaugcccaacucagggagaaccgucacugaacgaagaacaggauaaacgcuuugugugcaagcauagcaugguggauagaggcuggggaaacggcuguggacucuucggaaaggguggaauugugacgugcgcaauguucacuugcaagaagaauauggaagggaagaucguccagccggagaaccuggaauacacuaucgugaucaccccgcacucaggcgaggagaacgcagugggcaacgauaccgggaagcacgggaaggaaaucaaggugaccccgcagucguccauuaccgaggccgaacucaccggauacggcacugugacuauggaaugcucgccacggaccgggcuggauuucaaugagauggugcucuugcaaauggagaacaaagccuggcugguccaccgccagugguuccucgaccucccccuuccguggcugccgggagcugacacccaaggauccaacuggauccaaaaagaaacccuugucacguuuaagaauccacaugccaaaaagcaggacguggucgugcucggaagccaggaaggagccaugcacacugcgcugacuggagcaaccgaaauucaaaugucgagcggcaaccuccucuucacuggacaucugaagugccggcugcgcauggacaaacugcaacuuaagggcaugucauacucgauguguaccggcaaauucaagguggugaaggagaucgcggagacucagcacgggaccaucgucauccggguccaguaugagggugaugguucccccugcaagaucccuuucgaaaucauggaucuggagaaacgucacgugcugggccggcugaucacugugaauccgaucguuacggagaaagacagcccggugaacaucgaagcugaaccgccguuuggggauagcuacauuaucaucggcguggaaccaggccagcucaaguugucgugguucaagaaagga

SEQ ID NO: 246 - RNA, 2544 nt, Artificial Sequence
  Synthetic Polynucleotide
auggaugcuaugaaaagaggccuguguuguguguugcuguugugcggagcuguguuugugucaccuuuccaccugacuacccgcaauggugagccccauaugauugugucgcgccaggagaaggggaagucccuccuguucaaaacugaaaacggcgugaacauguguacccugauggccauggaccuuggagaacugugcgaggacaccaucaccuacaauuguccgcuccugcgccaaaacgaaccagaagauaucgacugcuggugcaauuccacuucaaccuggguuaccuacggaacuugcaccgccacgggagaacacagaagagaaaagcgcucgguggcgcuggugccucaugucggaaugggacuggagacucggacggagacuuggauguccucggagggagcauggaaacaugcccaacggaucgaaacuugggugcugaggcacccuggauucaccaucauggcagcgauccucgccuacacuauagguacuaccuacuuucaaagggugcugaucuucauucuccucaccgcaguggccccuucaaugaccaugaggugcauugggaucucgaaccgggacuucgucgaaggaguguccggagguagcugggucgacaucguccuggaacacggaagcugcgugacuacuauggcgaagaacaagccaaccuuggacuucgagcuuaucaagaccgaggcgaagcacccggccacucugagaaaguacugcaucgaggcuaagcucaccaacacgaccacugccucgcgaugcccaacucagggagaaccgucacugaacgaagaacaggauaaacgcuuugugugcaagcauagcaugguggauagaggcuggggaaacggcuguggacucuucggaaaggguggaauugugacgugcgcaauguucacuugcaagaagaauauggaagggaagaucguccagccggagaaccuggaauacacuaucgugaucaccccgcacucaggcgaggagaacgcagugggcaacgauaccgggaagcacgggaaggaaaucaaggugaccccgcagucguccauuaccgaggccgaacucaccggauacggcacugugacuauggaaugcucgccacggaccgggcuggauuucaaugagauggugcucuugcaaauggagaacaaagccuggcugguccaccgccagugguuccucgaccucccccuuccguggcugccgggagcugacacccaaggauccaacuggauccaaaaagaaacccuugucacguuuaagaauccacaugccaaaaagcaggacguggucgugcucggaagccaggaaggagccaugcacacugcgcugacuggagcaaccgaaauucaaaugucgagcggcaaccuccucuucacuggacaucugaagugccggcugcgcauggacaaacugcaacuuaagggcaugucauacucgauguguaccggcaaauucaagguggugaaggagaucgcggagacucagcacgggaccaucgucauccggguccaguaugagggugaugguucccccugcaagaucccuuucgaaaucauggaucuggagaaacgucacgugcugggccggcugaucacugugaauccgaucguuacggagaaagacagcccggugaacaucgaagcugaaccgccguuuggggauagcuacauuaucaucggcguggaaccaggccagcucaaguugucgugguucaagaaaggaggagguggaggauccggaggcggagggucgggcggugguggaucggaggucaaacugcagcaaucagggaccgaagucgugaagccgggggcuucagucaagcuguccugcaaggccagcggcuauaucuucacuagcuacgacaucgauugggugcggcagacuccggagcaaggacucgaguggauuggguggaucuuuccgggcgagggaucaaccgaguacaacgaaaaauuuaagggacgggcaacgcuguccguggacaagagcucaucuacggcguacauggagcugacgcggcucacgucagaggauuccgccgucuacuucugugccaggggcgacuacuaccggcgcuacuuugaucuguggggacaaggaacgaccgugacugucucaucaggcggcggcggaucgggaggaggcggaucggguggcggugguucggacauucagaugacucaaucgcccagcuuccugucgaccucacuggggaauucuauuacgaucacuugucacgcuucgcagaacaucaaggguuggcuggcuugguaccagcagaaaagcgguaacgccccgcaacugcucaucuacaaggcaucgucccugcaaucgggagugccgucacgcuuuucaggaucgggcuccggaaccgauuacaucuuuaccaucagcaaccugcagccggaagacaucgccacuuacuacugucaacacuaucagagcuuuccguggaccuuuggaggggggaccaaauuggagaucaagcgcgacuacaaggaugacgaugacaaa

SEQ ID NO: 247 - RNA, 916 nt, Artificial Sequence
  Synthetic Polynucleotide
auggauuggaccuggaucuuguuucucgucgccgcagccacucgcguucauagcaaaggaaugucauacuccaugugcacgggaaaauucaagguggucaaagagaucgcggagacucagcacggcaccaucgucauucgcgugcaaacugaaggagauggaucucccugcaagaucccguucgagaucauggaccuggaaaagagacacguccucgguagacugaucaccgugaacccgaucgugacggagaaggauuccccggugaauauugaagcagagccuccauuuggggacucauacauuaucauuggggucgagccgggccagcugaagcugaauugguuuaagaagggcucgucaaucggacagauguucgaaacuacuaugaggggugcaaagcggauggcgauccucucgggcggagauaucaucaaacuccuuaacgaacaggugaacaaggagaugcaguccucaaaccuuuacaugagcaugucguccugguguuacacccauagccuggacggcgcuggauuguuccuguuugaccaugcagcggaggaauacgaacacgccaagaagcucaucaucuuccugaacgagaauaacgugccagugcaacugaccuccaucucggcuccugagcacaaguucgaaggacucacccagaucuuccaaaaggccuacgaacacgaacagcacaucagcgaauccaucaacaauaucguggaccaugcuaucaaaagcaaagaccaugcgaccuucaacuuccugcaaugguaugucgccgaacagcacgaagaggaggugcuguucaaggacauucucgacaaaaucgaauugauagggaacgaaaaucacggucuguaccuggccgaucaauacgugaagggaauugccaagucgcggaagucgu

SEQ ID NO: 248 - RNA, 2058 nt, Dengue Virus
augcugaauauucugaaccgccgccgccggacugccgggauuauaauuaugaugauucccaccgugauggccuuccaccugaccacccggaacggggaaccacauaugaucguguccagacaggagaagggaaagucccugcuguucaagaccgaggacggcgugaacaugugcacccucauggcuauggaccugggcgaacucugcgaggacaccaucaccuacaagugcccccuguugaggcagaacgagccggaggauauugacugcuggugcaauucgaccagcaccugggucaccuacgggacuugcaccacaaccggagaacaucggcgcgaaaagcgcagcguggcuuuggugccucacgucggaauggggcuggagacuagaaccgagacuuggaugucgucggaaggggccuggaaacacgcacagcgcaucgaaacuuggauacucaggcaucccggcuucaccauuauggccgcgauccuggcauacaccaucgguacuacccacuuccaacgggcccugaucuuuauccuccugaccgcugucgcaccauccaugaccaugcgguguaucgguaucagcaacagggacuucguggagggagugucgggaggauccuggguggauauugugcuggaacacgguuccugcgucacuaccauggcgaagaacaagccuacccuggacuuugagcugaucaaaacugaggccaagcagccggccacccugcgcaaguacugcaucgaagccaagcugaccaauaccacuaccgaaucccgcuguccgacccaaggggagcccucccugaaugaggagcaggacaagcgcuucgucugcaagcauucaauggucgaccgcggcuggggaaacggcugcggacuguucggaaagggcggcauugugaccugugccauguucacuugcaagaagaacauggaaggaaagaucgugcagcccgaaaaccuggaguauaccaucgucgugaccccgcacuccggggaagaacacgcugugggaaacgacaccggaaagcacggaaaggagaucaaagugaccccacagucgagcauuaccgaggccgaacuuacugguuacggcacugugacgauggaauguucaccgagaacuggacuggauuucaacgaaauggugcugcuccaaauggaaaacaaggccuggcuggugcaccgccagugguuucuugaccucccucucccuuggcugccuggagcagacacucaggguuccaacuggauucagaaggaaacacucgugaccuucaagaacccucacgcgaagaagcaggauguggucgugcugggaagccaggagggagcgaugcauaccgcccucaccggcgcgacggagauucagauguccagcggaaaccuucuguucaccggacaccugaagugcagacugaggauggacaagcugcagcucaagggaauguccuacuccaugugcacuggaaaguucaaggucgugaaggagauugccgaaacucagcaugguaccaucgugauccgggugcaauaugaaggggacggauccccgugcaagaucccuuucgaaaucauggacuuggagaagcgacacgugcugggcagacugaucacagucaaccccaucgugacugagaaggauucacccgugaacauugaagccgagccgccuuucggcgauagcuacaucaucauuggcguggaaccgggacagcuuaagcucaacugguucaagaaggguuccucgaucggucaaauguuugaaaccacgaugcggggugccaaacggauggccauucugggagacaccgccugggauuucggcuccuugggcggaguguucacuucuaucggaaaggcgcugcaccaaguguucggagccaucuacggcgccgcguucucgggcgucagcuggaccaugaagauucugaucggggucaucaucacuuggauugggaugaacucacgguccaccucccugagcgugucccuuguccuggucggcaucgugacccuguaccucggagugauggugcaggcuuag

SEQ ID NO: 249 - RNA, 2058 nt, Dengue Virus
augcuuaacauucucaaccgccgccggagaacugcugguauuaucauuaugaugauucccacugugauggccuuccaccugaccacgcggaacggcgaaccccauaugauugucggucggcaggaaaaggggaagucccugcuguucaaaacugaggacggagugaacaugugcacccucauggcuauugaccugggagagcugugcgaagauacuaucacguacaagugcccccugcugcgccagaacgagccugaggacauugacugcuggugcaacuccacgucaaccugggucaccuacggaacuugcgcgacuaccggcgaacaucgcagagaaaagagaagcguggcccucgugccgcacgucgggauggggcuggaaacccggaccgaaaccuggauguccucggaaggcgccuggaagcacgugcagaggaucgaaacuuggauccuccggcacccgggauucaccaucauggccgccauccucgcuuacacaaucggaaccacucacuuucaacgcgcccugaucuucauccugcuuaccgccguggccccguccaugaccaugcgcugcauuggaaugucaaaccgggacuucgucgagggagucuccggaggaagcuggguggacaucgugcuggagcacggcagcugugugaccaccauggccaagaacaagccaacucuugauuucgaacugaucaagaccgaggccaagcagccugccacucugaggaaguacuguaucgaagcgaagcugaccaacaccacuaccgaaucccgcugcccgacccagggcgaaccuuccuugaacgaagaacaggacaagagauucgugugcaagcauagcauggucgacaggggaugggggaacggauguggacucuuugggaagggcggaaucgucaccugugcgauguuccggugcaagaagaacauggaggggaaggucgugcagcccgaaaaucucgaguacacuaucgugaucaccccgcauuccggagaggagcacgccgugggcaacgacaccgggaagcacggaaaggagaucaaaauuaccccucaauccuccaccaccgaagccgaauugacugguuacgguaccgugacuauggagugcucgccgcggacuggcuuggacuucaacgagauggugcugcugcaaauggagaacaaggccuggcuggugcaccggcagugguuucuugaucugccucugccuuggcugcccggagccgacacccaggguagcaauuggauccagaaagagacacucgugaccuuuaagaacccgcacgcaaagaagcaggaugucgugguccugggaagccaagaaggggcaaugcauaccgcacucacuggagccacugaaauccagauguccuccggcaaucugcuguucaccggccaucugaagugccgacugcgcauggacaagcuccagcuuaagggaauguccuacuccauguguacuggaaaguucaaagucgugaaggaaauugccgaaacccagcacggcaccauagugauccgggugcaguacgagggcgacggcucacccugcaaaaucccguucgagauuauggaucucgaaaagcgccacgugcugggcagacugauuaccgugaacccuaucgugaccgagaaggauuccccagugaacaucgaggccgaaccgcccuucggagacucguauaucaucaucggcguggagcccggccagcugaagcugaacugguucaagaaggggucgagcaucggccagauguucgagacuaccaugcgcggcgcgaagaggauggcgauccugggggauaccgcuugggacuucgguucccucggcgggguguucaccucgauugggaaggcccuccaccaaguguucggugcaaucuacggagcggcguucagcggagugucguggaccaugaagauucugaucggcgugaucaucaccuggauuggcaugaacucccggucuacuagccugucggugacccuggugcuggucggaaucgugaccuuguaccugggagugauggugcaagcuuag

SEQ ID NO: 250 - RNA, 2058 nt, Dengue Virus
augcugaacauccugaaccgcagaaggagaaccgccgguauuauuauuaugaugauccccaccgugauggcauuccaccugacuacccgcaacggagagccgcauaugaucgugggccgccaggaaaagggaaagucccugcuguucaagacugaggacggcgugaacaugugcacucucauggccaucgaccucggcgaacugugcgaggacaccauuacuuacaagugcccgcugcugagacagaacgagccugaggacaucgacuguugguguaacucgaccuccaccugggucaccuacggaacgugcgccacaaccggagaacaccgccgggaaaagcggagcguggcucuggugccgcacgucggaaugggucuggagacuagaaccgaaaccuggaugucauccgagggggcauggaaacaugugcagcgaaucgagacuuggauccugagacacccgggcuucacuaucauggcggccauccuugccuacaccauuggcacuacucacuuccaacgggcgcugaucuucauacugcucaccgcgguggcccccuccaugacgaugcgcugcaucggaaucuccaaccgggacuucguggagggcgucagcggaggcagcuggguggacaucguguuggagcacggaagcugcgugaccaccauggccaagaacaagcccacucuugauuuugagcugaucaagacggaagcaaagcagccggccacucugaggaaguacugcaucgaggccaagcucaccaacacaaccaccgaaucucggugcccgacccaaggagagccaucacugaacgaggaacaggacaagagauuccugugcaaacauucgaugguggacaggggauggggaaaugguugcggccuguucggcaaaggaggcauugugaccugugcgauguucacuugcaagaaaaacauggaggggaaggucguguugccggagaaccuggaguacacuaucgugauuaccccgcacuccggggaggaacaugccgugggaaaugacaccggaaagcacgggaaggaaaucaaaaucacgccucaguccucaaucaccgaagccgagcuuaccggcuacgguaccgugaccauggagugcagcccucggacuggacuggacuucaacgagauggugcugcugcaaauggaagauaaggccuggcuggugcaccggcagugguucuuggauuugccacugccuuggcugcccggcgcggauacccaggguuccaacuggauucagaaggaaacccucgugaccuucaagaauccucacgccaagaagcaggacgugguggugcuggguucccaagaaggggccaugcauacugcccucacuggagcgaccgaaauccagaugucguccggcaaccuccuguucaccggccaccugaagugccgccugcggauggacaaguugcagcugaagggaaugagcuacucgauguguaccggaaaguucaagaucgugaaggaaaucgccgaaacccagcacggaaccaucgucauuagagugcaguacgaaggggacggcagcccgugcaagauccccuucgaaauuauggaccuggagaagcgccacgugcucggaaggcucaucacugucaacccaaucgucaccgaaaaggacuccccugugaacaucgaagcagagcccccuuucggggacuccuacauuauuaucggcguggagcccggccagcugaagcugaacugguucaagaagggauccucgaucggacagauguucgaaaccaccaugcggggagccaagcggauggcuauucugggagauaccgcuugggauuucggcucccucggcggcgucuuuacuuccaucgggaaagcgcuccaccaaguguuuggagccaucuacggugccgcuuuuuccggggugucauggaccaugaagauucuuaucggggucauuauuacuuggaucggcaugaacucccggagcaccucgcuguccgugagccucgugcucguggggguggucacucuguaucuuggugccauggugcaggccuag

SEQ ID NO: 251 - RNA, 2058 nt, Dengue Virus
augcuuaacauccugaauagaagaagaagaaccgccggcauuaucauuaugaugauacccaccgugauggccuuccaccugacuacucgcaacggagagccucauaugaucgugucgcggcaggagaagggaaagucccugcuguuuaagacggaggacggcgugaacaugugcacucuuauggcaauggaccuuggagagcugugcgaggauaccaucaccuacaaguguccguuccugaagcaaaacgagccugaggauauugacugcuggugcaacuccaccucaaccugggucacauaugggaccuguaccacuacuggcgaacaccgccgcgagaaaagaagcguggcguuggugccucacgucggcaugggucuggaaacucggaccgaaacuuggaugagcucagagggggcauggaagcacgcccagaggauugaaaccuggauucugcgccacccuggauucaccaucauggcggcuauucuggcguacacuauuggaaccacccacuuucagcgggcccuuaucuucauccuccucacugccguggcgcccuccaugacuaugcgguguaucggaauuuccaaccgcgacuucguggaaggaguguccggaggcuccugggucgacauugugcuggaacaugguucaugcgugaccacgauggccaagaacaagcccacccucgacuucgagcugaucgagacugaagccaagcagccggccacucugcggaaguacuguaucgaggccaagcucaccaacaccaccaccgauucccgcugcccgacccaaggagaaccuucgcucaacgaggagcaggacaagcgguucgugugcaagcacagcauggucgacaggggaugggggaauggaugcggucuguucggaaagggaggcauugugacuugugcaauguucacuugcaagaagaacaugaaggggaaggucgugcagccggaaaaccuggaguacaccaucgugaucaccccucauucgggcgaagaacacgcuguggggaaugauaccggaaagcacggaaaggaaauuaagaucacaccccaauccagcaucacugaggcagaacugaccggcuacggcacugugaccauggagugcucgccucggacuggccuggacuucaacgagauggugcugcuccaaauggaaaacaaggccuggcuggugcacagacagugguuccucgauuugcccuugccguggcucccuggcgccgacacccagggaucuaacuggauccagaaggaaacccuugugaccuucaagaacccgcacgcuaagaaacaggaugugguggugcugggaagccaggaaggagcaaugcauaccgcgcucacgggugccaccgagauccagaugagcuccgggaaccuccuguucaccggucaccugaagugccgacuccgcauggacaaacugcagcucaaggggauguccuacuccaugugcaccgggaaauucaaggucgugaaggagaucgcugagacucagcacgguacuaucgugauccgggugcaguaugagggagaugggagcccgugcaaaaucccauuugagaucauggacuuggaaaagcgccaugugcugggucggcugauuaccgugaacccaaucgucaccgaaaaggacagccccgucaacauugaagccgaaccacccuucggagacucguacaucaucauuggcguggaaccgggccagcugaagcugaacugguucaaaaagggguccucuaucggccaaaugaucgaaaccaccaugcggggagcuaagcggauggcgauuuugggagacacugcgugggacuuuggcucacuggggggaguguucaccagcaucggcaaagcccugcaccaaguguucggugccaucuacggagccgccuucagcggaguguccuggaucaugaagauccugaucggcgugaucauuaccuggaucggcaugaacuccagguccaccucgcucuccgugucgcuggugcuggucggggucgugacccuguaccugggagugaugguccaggccuga

SEQ ID NO: 252 - RNA, 2058 nt, Dengue Virus
auguugaauauccugaaccgccgccggagaacugccggaauuaucauuaugaugaucccuaccgugauggcguuccaccuuacuacccggaacggggagccucacaugaucgugucacgccaggagaaggggaaaucccugcuguucaagaccaaggacgguaccaacauguguacccugauggcgauggaccucggagagcugugcgaggacaccaucaccuacaaaugcccguuccugaagcagaacgagccggaagauauugacuguuggugcaacuccaccuccacuugggucaccuacggaacuugcaccacuacuggggagcauagacgggagaagcgcuccguggcccuggugccgcacgucggcaugggacuggaaaccagaaccgagacuuggauguccagcgaaggcgccuggaagcacgcccagcggauugaaacuuggauccugaggcacccggguuuuaccauuauggccgcuaucuuggcauacaccaucggcaccacccacuuccaacgcguccugaucuucauccugcugaccgccauugcgcccuccaugaccaugcggugcaucggaaucagcaaccgcgacuucguggaaggcgucagcggcgguucuuggguggacaucguguuggagcacggaucgugcgugaccaccauggccaagaacaagccgacccucgauuucgagcugaucaagacugaagccaagcagccagcuacccugcggaaguauugcaucgaagccaagcucacuaauacuacgaccgacagccgguguccgacccaaggagagcccacccugaaugaggaacaagacaagcgcuucgugugcaagcauuccaugguggaccggggcuggggaaacggcugcggacuguucgggaaaggaggaauugugacuugcgccauguucacuugcaagaagaacauggaggggaagaucguccagccugagaaccucgaguacacggucgugauuacuccgcacucgggagaagaacacgccgugggcaacgacaccggaaagcaugggaaggaagugaaaaucacgccccaaucgucgauuaccgaggcugagcugaccggcuacggcaccgugaccauggagugcuccccgaggaccggacuggacuucaacgaaauggugcugcugcagaugaaggacaaggccuggcuggugcaccgccagugguuccucgaccucccacuccccuggcugcccggagcggauacgcagggauccaacuggauccagaaggaaacucuugugaccuucaagaacccucaugccaagaagcaggacguggugguccugggaucccaagagggcgcgaugcacaccgcacugaccggcgccaccgaaauucagauguccuccggaaaccuccuguucacuggccaccugaagugcagacuccgcauggacaagcugcagcucaaggggaugagcuacuccauguguaccggaaaauucaaggucgugaaggaaauugcagaaacacagcaugggacaauugucauucggguccaguacgagggcgaugguucaccgugcaagacuccauucgagaucauggaucuggagaaaagacacgugcugggucggcugacuaccgugaacccaaucgugacugagaaggacucccccgugaacaucgaagccgagccuccuuuuggcgauuccuacaucaucauuggaguggaacccggacagcuuaaguuggauugguucaagaagggcuccucgaucggacagauguucgaaaccaccaugcgcggugccaagcgaauggccauccugggggacaccgccugggacuucgguagccugggcggaguguuuaccucaauuggaaaggcucugcaccaaguguuuggggcgaucuacggagcggccuucagcggugucuccuggacuaugaagauucucaucggagugauaaucaccuggaucggcaugaacagccggucaaccagccuguccgugucccuggugcuggucggcaucgugacucucuaccucggagugauggugcaggccuag

SEQ ID NO: 253 - RNA, 2058 nt, Dengue Virus
augcucaacauacugaacagacggagaaggaccgccgguauuauuaucaugaugaucccuacugugauggcauuccaccugacaacccgcaacggagagccccacaugaucgugucacgccaggagaaagggaagucacugcuguucaagaccgaagucggcgugaacauguguacccugauggcgauggaucuuggcgaacugugcgaggacaccaucacguacaagugcccccuguugcggcaaaacgaaccagaggacaucgacugcugguguaacuccaccucgaccugggucaccuacggaaccuguaccacuaugggggaacaccggcgggagaagcgcuccguggcgcucgugccucaugucggcaugggacuggagacucggacugaaaccuggaugucgucggagggggccuggaagcacguccagcggaucgagacuuggauccuucgccauccgggcuucaccaugauggccgccauccuggccuacaccaucggaaccacccauuuccaacgggcccugauccugauccuguugacugccgugacccccuccaugacuaugcggugcauugggaugucgaacagggauuucguggagggagucagcgguggcagcuggguggacaucgugcuggaacauggauccugcgugacuaccauggcaaagaacaagccaacccucgauuucgaacugaucaagaccgaggcgaaacagccggcgacccugaggaaguacugcaucgaggccaagcucaccaacaccacuaccgagagcagaugcccuacccaaggggaaccuucccugaacgaggagcaggacaagagauucgucugcaagcacuccaugguggaccgcggcuggggaaacggaugcggacucuucggaaagggcgguauugugaccugugccauguuccgcugcaagaaaaacauggaagggaaaguggugcagcccgagaaccucgaguacacuaucgugaucacaccgcacagcggagaagaacacgccgugggcaacgacacuggaaagcacgggaaggaaaucaagaucaccccgcaauccucaaucacugaggcugaguugaccggcuacgggacuauuaccauggaaugcuccccacgaacgggacuggacuucaacgaaauuguguugcuccaaauggaaaacaaggccuggcucgugcaccggcagugguuccuggaucugccccugccguggcugccgggugccgacacucaggggagcaacuggauucagaaggaaacccuugugaccuucaagaacccccacgcaaagaagcaggacgugguggugcuggguagccaagaaggcgccaugcacacggcccugaccggagcgaccgagauccagauguccagcggaaaucugcucuuuacuggucaucugaagugcagacuucggauggacaagcugcaacugaagggaauguccuacucaaugugcacuggaaaguucaaggucgugaaggagaucgccgaaacccagcacgggacuaucgucauccgcgugcaguacgaaggagauggcuccccgugcaagaucccuuucgaaaucauggaccuggagaagcgccacguguuggggcgccuuauuacugugaaccccaucgugaccgagaaggacuccccugucaacaucgaggcugaaccgccauucggagauuccuauaucauuaucggaguggaaccgggccagcucaagcugaauugguucaagaagggauccucgauuggccagauguucgaaacgacuaugcggggcgcuaagcgcauggccauccugggcgauacugccugggauuuugguucucugggcggaguguucaccuccauuggaaaggcccugcaccaaguguucggcgccaucuacggugccgcguuuagcggugucucauggaccaugaaaauccucauuggcgugaucauuaccuggauuggcaugaacuccagaagcacuucccuguccgugacccuggugcucgucggaauugugacacucuaccucggagugauggugcaggcuuga

SEQ ID NO: 254 - RNA, 2058 nt, Dengue Virus
augcugaacauuuugaacagacgccgaaggaccgcaggcauuaucauuaugaugaucccuaccgugauggccuuccaucugacuacuaggaacggagagccacauaugaucgugucgcgccaggaaaagggaaagagccugcuuuuuaaaaccaaggacggcacgaacaugugcacccuuauggccauggaccugggggaguugugcgaggacaccaucaccuacaagugcccguuccugaagcaaaacgagcccgaagauauugacugcuggugcaacuccaccuccaccugggucacuuaugggacuugcaccaccaccggcgaacaucgcagagaaaagagaagcguggcccuggucccccacgucgggaugggccucgagacucggaccgaaacuuggaugucaucagagggcgcauggaagcaugcucagcggaucgaaaccuggauccugagacacccugguuucacaauuauggccgccauucuugcguacacgaucggaacgacucauuuccaacgcgugcugaucuucauucuccugaccgcuauugcgccguccaugacuaugcggugcaucggaaucucaaaccgggacuucguggaaggagugucgggaggauccuggguggacauugugcuggagcacgguuccugcgucaccaccauggccaaaaacaagccuacccuggacuucgagcugaucaagacugaggccaagcagcccgcgacccuccggaaguacugcaucgaggccaaguugaccaacacuacuaccgauucccggugcccgacccaaggagaaccaacucugaacgaagaacaggauaagcgguuugugugcaagcacucaaugguggacaggggauggggcaacggcuguggacuguucggaaagggugguauugugaccugugcaauguuuaccuguaaaaagaauauggaggggaagaucgugcagccugaaaaucucgaguacacugucgucaucaccccgcacucgggagaggagcacgcugugggcaacgacaccggaaagcacggaaaggaggucaagauaaccccgcaauccuccauuacggaagccgaacugacugguuacggcaccgugacuauggagugcuccccucggaccggccuggacuucaacgaaauggugcugcuccaaauggaagauaaggccuggcuggugcacaggcagugguuccuggaucucccgcugccguggcugccuggcgcugacacucagggaagcaacuggauccagaaggaaacccucgugaccuuuaagaacccccacgccaagaagcaggauguggugguguugggaagccaggagggggccaugcauacugcccucaccggcgcgaccgaaauccagaugucguccggcaaucugcuguucaccggacaccucaagugucgccuucggauggacaagcugcagcugaagggaaugagcuacagcaugugcaccgggaaguucaagaucgugaaggaaaucgccgaaacccagcacggaaccaucgugauccgggugcaguacgagggcgacgguucucccugcaaaauccccuucgaaaucauggaucuggagaagagacacguccugggucgccugaucaccgugaaccccauugugacugagaaggacuccccagugaacaucgaagcggagcccccauucggagacagcuacauuaucauuggugccgaaccggggcagcugaaacuggacugguucaagaagggcagcucgauuggccaaauguucgaaacgacaaugcggggcgcaaagcgcauggccauccugggagacacugccugggacuucgggucccuuggggggguguucaccucgaucggaaaagccuugcaccaaguguucggcgcaaucuacggcgccgcguucucgggagucuccuggacuaugaagauccugaucggugucaucaucaccuggaucgggaugaacucccgguccacuucccucucggugucacucgugcuugugggaauugucacccuguaccucggagugauggugcaggccuga

SEQ ID NO: 255 - RNA, 2058 nt, Dengue Virus
augcugaauauucugaaccgacgccgccgcacugccggaaucauuaucaugaugaucccuaccgugauggcguuccaucucaccacucggaauggcgaaccccauaugaucgugucgagacaggaaaagggaaagagccuuuuguucaaaacugaagauggagugaacaugugcacucucauggcaauggaucugggcgaacugugcgaagauaccaucacuuacaaguguccgcuguugagacagaacgagccugaggacaucgacugcugguguaacagcacuuccaccugggucaccuacggcacuugcacuaccaccggagaacaccggcgcgagaagaggagcguggcucuugugccgcacgucggcaugggacucgagacucggaccgaaaccuggaugucauccgaaggagccuggaaacacgcccaacggaucgaaauuuggauccugagacaccccgguuucacuaucauggccgcaauccuggcguacacuauuggcaccacgcacuuccagagggcccucauuuucauccuccugacugccguggcgccauccaugaccaugagauguauuggcauuuccaaccgcgauuucguggagggaguguccggaggauccugggucgacaucgugcuggaacacggaucuugcgucaccaccauggcuaagaacaagcccacccucgacuucgagcugaucaagacagaagccaagcagccggccacccuccgcaaguauugcauugaagccaagcuuaccaacaccaccaccgagucgcggugcccaacccaaggagagccgagccucaaugaggaacaggacaagcgcuucgugugcaaacacagcauggucgaccgggguuggggcaacggauguggccuguucgggaaggguggcauugugacuugcgcaauguucacuugcaagaagaacauggaggggaaaguggugcaacccgagaaccuggaguacaccaucgucgugaccccacacuccggagaggagcacgccgugggaaacgacacggggaagcauggaaaggagaucaaggucacaccccaaucaucuauuaccgaggccgaacugaccggauacgguacugugacgauggagugcagcccgaggacuggacuggacuucaacgaaauggugcugcugcaaauggagaacaaggccuggcucgugcaccggcagugguuucuggaucucccacugccgugguugccgggagccgacacccaggggucgaacuggauccagaaggaaacucuugugacguuuaagaauccucacgcgaagaagcaggacguggugguccugggaucgcaggaaggagcuaugcacaccgcucugaccggcgccacugagauccagauguccucgggcaaccuccuguucaccggucaucugaagugccggcugcggauggacaaauugcagcugaaggggauguccuacuccaugugcaccgggaaguucaaggucgugaaggagaucgcggaaacucagcacggcaccauugucauuagagugcaguacgagggagaugguucaccgugcaagauaccguucgaaaucauggaccuggaaaagagacaugucuugggacgccugaucacugugaacccuaucgugaccgaaaaggacuccccugugaacaucgaggcggagccgccuuucggcgacuccuacaucauuaucggaguggagcccgggcagcugaagcucaacugguuuaagaagggguccagcaucggccagauguucgaaaccaccaugcggggggcgaagaggauggcgauccugggagacaccgccugggauuucgguucacugggcggaguguucaccuccaucggaaaggcccugcaccaaguguucggcgcaaucuacggugcugccuucucgggagucuccuggaccaugaagauccugaucggcgugauuaucacauggaucggcaugaacagccggucaaccucccuuuccgugucccuggugcuggucggcaucgugacucuguaccugggcgugauggugcaggccuga

SEQ ID NO: 256 - RNA, 2058 nt, Dengue Virus
augcugaacauucugaaccggagaagaagaaccgccggcauuauuaucaugaugauucccacugugauggcauuucaccugaccacccggaacggagaaccucauaugaucgugucgagacaggagaagggaaagucccugcuguucaagacagaaaacggagugaacaugugcacccugauggccauggaucucggcgaacugugcgaggauacuaucaccuacaacuguccguugcugcgccaaaacgagccggaggacaucgacugcugguguaacuccacgucgaccugggucaccuacggcacuugcaccgcgaccggcgaacacagaagagagaaacgcuccgucgcucuggugccgcacgucgggauggggcuugaaacccggacugaaaccuggaugagcucggagggcgcuuggaagcaugcccagcgcaucgaaacuugggugcugaggcauccaggcuucacaaucauggccgccauccucgcguacaccaucgguacuacguacuuccagcggguguugaucuucauucugcugaccgccguggccccuagcaugaccaugcggugcaucgggaucuccaaccgcgauuucguggaggggguguccgguggaagcuggguggacauugugcuggagcacggcucgugcgugaccaccauggccaagaacaagcccacccuugauuuugagcugaucaagaccgaagcgaaacaccccgcgacccuccggaaguacugcauugaagccaagcucaccaacacuaccacggccucccggugcccuacccaaggagaaccuuccuugaacgaagaacaggacaagcgcuucgugugcaagcauucaaugguggaccggggcuggggaaauggcuguggccucuucggaaaaggcggaauugugacuugcgcaauguucacuugcaagaagaacauggagggaaagauugugcagcccgagaaccucgaguacacuauugucaucacuccccacuccggcgaagaaaacgcugucggcaacgacaccggaaagcauggaaaggagaucaaggucaccccgcaauccucaauuacugaggcagaacugaccgguuacggaacugugacuauggaguguuccccucgcaccggccucgauuucaacgagauggugcugcugcaaauggagaacaaggccuggcuggugcaccggcagugguuccucgauuugccccugccguggcugccgggagccgacacucagggauccaacuggauccagaaagaaacccucgugaccuucaaaaacccccacgcgaagaagcaggacgugguggugcuggguucccaagaaggggcgaugcauaccgcccugacuggugcuaccgaaauccagaugucaagcggaaaucuccuguuuaccggucaccugaagugcaggcuccggauggacaaguugcagcugaaggggaugucguacagcauguguacugggaaguucaaggucgugaaggagauugccgaaacccagcacggaaccauagucaucaggguccaguacgagggcgacggcagcccuugcaagaucccguucgagaucauggaucuggagaagcgacacgugcugggccggcuuaucacugugaauccaaucgugaccgagaaagacucgcccgugaacaucgaagccgagccgccguucggcgacucauacaucaucaucggcguggaaccaggacagcugaagcugucaugguucaagaaggguuccagcauuggucagauguucgaaacaacgaugcgcggagccaagcgcauggcuauccuuggggacaccgccugggacuucgggucgcugggaggaguguuuaccagcaucggaaaggcccugcaccaaguguucggugccaucuacggagccgcauuuuccggagugucguggacuaugaagauucugaucggcgucgugauuaccuggaucgggaugaacuccaggucuacuucccucuccgugagccuggugcuggucggcguggucacccuguaucugggcgugaugguccaggcuuag

SEQ ID NO: 257-258 - skipped (2 entries)

SEQ ID NO: 259 - protein, 3389 aa, Dengue Virus
MNNQRKKTGRPSFNMLKRARNRVSTVSQLAKRFSKGLLSGQGPMKLVMAFIAFLRFLAIPPTAGILARWGSFKKNGAIKVLRGFKKEISNMLNIMNRRKRSVTMLLMLLPTALAFHLTTRGGEPHMIVSKQERGKSLLFKTSAGVNMCTLIAMDLGELCEDTMTYKCPRITETEPDDVDCWCNATETWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGNRDFVEGLSGATWVDVVLEHGSCVTTMAKDKPTLDIELLKTEVTNPAVLRKLCIEAKISNTTTDSRCPTQGEATLVEEQDTNFVCRRTFVDRGWGNGCGLFGKGSLITCAKFKCVTKLEGKIVQYENLKYSVIVTVHTGDQHQVGNETTEHGTTATITPQAPTSEIQLTDYGALTLDCSPRTGLDFNEMVLLTMKKKSWLVHKQWFLDLPLPWTSGASTSQETWNRQDLLVTFKTAHAKKQEVVVLGSQEGAMHTALTGATEIQTSGTTTIFAGHLKCRLKMDKLILKGMSYVMCTGSFKLEKEVAETQHGTVLVQVKYEGTDAPCKIPFSSQDEKGVTQNGRLITANPIVTDKEKPVNIEAEPPFGESYIVVGAGEKALKLSWFKKGSSIGKMFEATARGARRMAILGDTAWDFGSIGGVFTSVGKLIHQIFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVSGILAQGKKMIRPQPMEHKYSWKSWGKAKIIGADVQNTTFIIDGPNTPECPDNQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKTIHEWCCRSCTLPPLRFKGEDGCWYGMEIRPVKEKEENLVKSMVSAGSGEVDSFSLGLLCISIMIEEVMRSRWSRKMLMTGTLAVFLLLTMGQLTWNDLIRLCIMVGANASDKMGMGTTYLALMATFRMRPMFAVGLLFRRLTSREVLLLTVGLSLVASVELPNSLEELGDGLAMGIMMLKLLTDFQSHQLWATLLSLTFVKTTFSLHYAWKTMAMILSIVSLFPLCLSTTSQKTTWLPVLLGSLGCKPLTMFLITENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAISGVYPMSIPATLFVWYFWQKKKQRSGVLWDTPSPPEVERAVLDDGIYRILQRGLLGRSQVGVGVFQEGVFHTMWHVTRGAVLMYQGKRLEPSWASVKKDLISYGGGWRFQGSWNAGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLVLAPTRVVASEMAEALKGMPIRYQTTAVKSEHTGKEIVDLMCHATFTMRLLSPVRVPNYNMIIMDEAHFTDPASIAARGYISTRVGMGEAAAIFMTATPPGSVEAFPQSIQDEERDIPERSWNSGYDWITDFPGKTVWFVPSIKSGNDIANCLRKNGKRVVQLSRKTFDTEYQKTKNNDWDYVVTTDISEMGANFRADRVIDPRRCLKPVILKDGPERVILAGPMPVTVASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGKAYRHAMEELPDTIETLMLLALIAVLTGGVTLFFLSGRGLGKTSIGLLCVIASSALLWMASVEPHWIAASIILEFFLMVLLIPEPDRQRTPQDNQLAYVVIGLLFMILTVAANEMGLLETTKKDLGIGHAAAENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIIEVDRSEAKEGLKRGETTKHAVSRGTAKLRWFVERNLVKPEGKVIDLGCGRGGWSYYCAGLKKVTEVKGYTKGGPGHEEPIPMATYGWNLVKLYSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFSPSELETPNLAERVLDWLKKHGTERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEDVPYLGKREDQWCGSLIGLTARATWATNIQVAINQVRRLIGNENYLDFMTSMKRFKNESDPEGALW

SEQ ID NO: 260 - protein, 2535 aa, Dengue Virus
MNNQRKKAKNTPFNMLKRERNRVSTVQQLTKRFSLGMLQGRGPLKLFMALVAFLRFLTIPPTAGILKRWGTIKKSKAINVLRGFRKEIGRMLNILNRRRRSAGMIIMLIPTVMAFHLTTRNGEPHMIVSRQEKGKSLLFKTEDGVNMCTLMAMDLGELCEDTITYKCPLLRQNEPEDIDCWCNSTSTWVTYGTCTTMGEHRREKRSVALVPHVGMGLETRTETWMSSEGAWKHVQRIETWILRHPGFTMMAAILAYTIGTTHFQRALIFILLTAVTPSMTMRCIGMSNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFRCKKNMEGKVVQPENLEYTIVITPHSGEEHAVGNDTGKHGKEIKITPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVTLVLVGIVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLKEKQDVFCDSKLMSAAIKDNRAVHADMGYWIESALNDTWKIEKASFIEVKNCHWPKSHTLWSNGVLESEMIIPKNLAGPVSQHNYRPGYHTQITGPWHLGKLEMDFDFCDGTTVVVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKMVRNMEKYQLAVTIMAILCVPILQNAWKVSCTILAVVSVSPLLLTSSQQKTDWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGLFPVSIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNAGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALFLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKR

SEQ ID NO: 261 - protein, 853 aa, Dengue Virus
GETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRYKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKSIQHLTITEEIAVQNWLARVGRERLSRMAISGDDCVVKPLDDRFASALTALNDMGKIRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIQENPWMEDKTPVESWEEIPYLGKREDQWCGSLIGLTSRATWAKNIQAAINQVRSLIGNEEYTDYMPSMKRFRREEEEAGVLW

SEQ ID NO: 262 - protein, 3390 aa, Dengue Virus
MNNQRKKTGKPSINMLKRVRNRVSTGSQLAKRFSKGLLNGQGPMKLVMAFIAFLRFLAIPPTAGVLARWGTFKKSGAIKVLKGFKKEISNMLSIINQRKKTSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWASGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATERGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDTLGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWTNGVLESDMIIPKSLAGPISQHNYRPGYHTQTAGPWHLGKLELDFNYCEGTTVVITESCGTRGPSLRTTTVSGKLIHEWCCRSCTLPPLRYMGEDGCWYGMEIRPISEKEENMVKSLVSAGSGKVDNFTMGVLCLAILFEEVLRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGVALGLMALKLITQFETYQLWTALVSLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAPDVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTTPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEDGGRAYRHAVEELPETMETLLLLGLMILLTGGAMLFLISGKGIGKTSIGLICVIASSGMLWMAEVPLQWIASAIVLEFFMMVLLIPEPEKQRTPQDNQLAYVVIGILTLAATIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDSVIFDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGETTHHAVSRGSAKLQWFVERNMVVPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRPMPGTRKAMEITAEWLWRTLGRNKRPRLCTREEFTKKVRTNAAMGAVFTEENQWDSAKAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKIIQQMDPEHRQLANAIFKLTYQNKVVKVQRPTPTGTVMDIISRKDQRGSGQLGTYGLNTFTNMEAQLVRQMEGEGVLTKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEENPWMEDKTPVTTWENVPYLGKREDQWCGSLIGLTSRATWAQNIPTAIQQVRSLIGNEEFLDYMPSMKRFRKEEESEGAIW

SEQ ID NO: 263 - protein, 3387 aa, Artificial Sequence
  Synthetic Polynucleotide
MNQRKKVVRPPFNMLKRERNRVSTPQGLVKRFSTGLFSGKGPLRMVLAFITFLRVLSIPPTAGILKRWGQLKKNKAIKILIGFRKEIGRMLNILNGRKRSTITLLCLIPTVMAFSLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTAMITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRIISSTPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVASWSGKELKCGSGIFVVDNVHTWTEQYKFQPESPARLASAILNAHKDGVCGIRSTTRLENVMWKQITNELNYVLWEGGHDLTVVAGDVKGVLTKGKRALTPPVSDLKYSWKTWGKAKIFTPEARNSTFLIDGPDTSECPNERRAWNSLEVEDYGFGMFTTNIWMKFREGSSEVCDHRLMSAAIKDQKAVHADMGYWIESSKNQTWQIEKASLIEVKTCLWPKTHTLWSNGVLESQMLIPKSYAGPFSQHNYRQGYATQTVGPWHLGKLEIDFGECPGTTVTIQEDCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILVVVITLCAIILGGLTWMDLLRALIMLGDTMSGRIGGQIHLAIMAVFKMSPGYVLGVFLRKLTSRETALMVIGMAMTTVLSIPHDLMELIDGISLGLILLKIVTQFDNTQVGTLALSLTFIRSTMPLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIVEVKQDEDGSFSIRDVEETNMITLLVKLALITVSGLYPLAIPVTMTLWYMWQVKTQRSGALWDVPSPAATKKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILPDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYEDREWCFTGERNNQILEENMEVEIWTREGEKKKLRPRWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLKECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMTDKTPVHSWEDIPYLGKREDLWCGSLIGLSSRATWAKNIHTAITQVRNLIGKEEYVDYMPVMKRYSAPSESEGVL

SEQ ID NO: 264 - protein, 680 aa, Artificial Sequence
  Synthetic Polynucleotide
MDAMKRGLCCVLLLCGAVFVSPFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWVLRHPGFTIMAAILAYTIGTTYFQRVLIFILLTAVAPSMTMRCIGISNRDFVEGVSGGSWVDIVLEHGSCVTTMAKNKPTLDFELIKTEAKHPATLRKYCIEAKLTNTTTASRCPTQGEPSLNEEQDKRFVCKHSMVDRGWGNGCGLFGKGGIVTCAMFTCKKNMEGKIVQPENLEYTIVITPHSGEEGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQA

SEQ ID NO: 265 - protein, 580 aa, Artificial Sequence
  Synthetic Polynucleotide
MDAMKRGLCCVLLLCGAVFVSPFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWVLRHPGFTIMAAILAYTIGTTYFQRVLIFILLTAVAPSMTMRCIGISNRDFVEGVSGGSWVDIVLEHGSCVTTMAKNKPTLDFELIKTEAKHPATLRKYCIEAKLTNTTTASRCPTQGEPSLNEEQDKRFVCKHSMVDRGWGNGCGLFGKGGIVTCAMFTCKKNMEGKIVQPENLEYTIVITPHSGEEGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKG

SEQ ID NO: 266 - protein, 845 aa, Artificial Sequence
  Synthetic Polynucleotide
MDAMKRGLCCVLLLCGAVFVSPFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWVLRHPGFTIMAAILAYTIGTTYFQRVLIFILLTAVAPSMTMRCIGISNRDFVEGVSGGSWVDIVLEHGSCVTTMAKNKPTLDFELIKTEAKHPATLRKYCIEAKLTNTTTASRCPTQGEPSLNEEQDKRFVCKHSMVDRGWGNGCGLFGKGGIVTCAMFTCKKNMEGKIVQPENLEYTIVITPHSGEEGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGGGGGSGGGGSGGGGSEVKLQQSGTEVVKPGASVKLSCKASGYIFTSYDIDWVRQTPEQGLEWIGWIFPGEGSTEYNEKFKGRATLSVDKSSSTAYMELTRLTSEDSAVYFCARGDYYRRYFDLWGQGTTVTVSSGGGGSGGGGSGGGGSDIQMTQSPSFLSTSLGNSITITCHASQNIKGWLAWYQQKSGNAPQLLIYKASSLQSGVPSRFSGSGSGTDYIFTISNLQPEDIATYYCQHYQSFPWTFGGGTKLEIKRDYKDDDDK

SEQ ID NO: 267 - protein, 305 aa, Dengue Virus
MDWTWILFLVAAATRVHSKGMSYSMCTGKFKVVKEIAETQHGTIVIRVQTEGDGSPCKIPFEIMDLEKRHVLGRLITVNPIVTEKDSPVNIEAEPPFGDSYIIIGVEPGQLKLNWFKKGSSIGQMFETTMRGAKRMAILSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 268 - protein, 685 aa, Dengue Virus
MLNILNRRRRTAGIIIMMIPTVMAFHLTTRNGEPHMIVSRQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQA

SEQ ID NO: 269 - protein, 685 aa, Dengue Virus
MLNILNRRRRTAGIIIMMIPTVMAFHLTTRNGEPHMIVGRQEKGKSLLFKTEDGVNMCTLMAIDLGELCEDTITYKCPLLRQNEPEDIDCWCNSTSTWVTYGTCATTGEHRREKRSVALVPHVGMGLETRTETWMSSEGAWKHVQRIETWILRHPGFTIMAAILAYTIGTTHFQRALIFILLTAVAPSMTMRCIGMSNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFRCKKNMEGKVVQPENLEYTIVITPHSGEEHAVGNDTGKHGKEIKITPQSSTTEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVTLVLVGIVTLYLGVMVQA

SEQ ID NO: 270 - protein, 685 aa, Dengue Virus
MLNILNRRRRTAGIIIMMIPTVMAFHLTTRNGEPHMIVGRQEKGKSLLFKTEDGVNMCTLMAIDLGELCEDTITYKCPLLRQNEPEDIDCWCNSTSTWVTYGTCATTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFLCKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQA

SEQ ID NO: 271 - protein, 685 aa, Dengue Virus
MLNILNRRRRTAGIIIMMIPTVMAFHLTTRNGEPHMIVSRQEKGKSLLFKTEDGVNMCTLMAMDLGELCEDTITYKCPFLKQNEPEDIDCWCNSTSTWVTYGTCTTTGEHRREKRSVALVPHVGMGLETRTETWMSSEGAWKHAQRIETWILRHPGFTIMAAILAYTIGTTHFQRALIFILLTAVAPSMTMRCIGISNRDFVEGVSGGSWVDIVLEHGSCVTTMAKNKPTLDFELIETEAKQPATLRKYCIEAKLTNTTTDSRCPTQGEPSLNEEQDKRFVCKHSMVDRGWGNGCGLFGKGGIVTCAMFTCKKNMKGKVVQPENLEYTIVITPHSGEEHAVGNDTGKHGKEIKITPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMIETTMRGAKRMAILGDTAWDFGSLGGVFTSIGKALHQVFGAIYGAAFSGVSWIMKILIGVIITWIGMNSRSTSLSVSLVLVGVVTLYLGVMVQA

SEQ ID NO: 272 - protein, 685 aa, Dengue Virus
MLNILNRRRRTAGIIIMMIPTVMAFHLTTRNGEPHMIVSRQEKGKSLLFKTKDGTNMCTLMAMDLGELCEDTITYKCPFLKQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAIAPSMTMRCIGISNRDFVEGVSGGSWVDIVLEHGSCVTTMAKNKPTLDFELIKTEAKQPATLRKYCIEAKLTNTTTDSRCPTQGEPTLNEEQDKRFVCKHSMVDRGWGNGCGLFGKGGIVTCAMFTCKKNMEGKIVQPENLEYTVVITPHSGEEHAVGNDTGKHGKEVKITPQSSITEAELTGYGTVTMECSPRTGLDFNEMVLLQMKDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKTPFEIMDLEKRHVLGRLTTVNPIVTEKDSPVNIEAEPPFGDSYIIIGVEPGQLKLDWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQA

SEQ ID NO: 273 - protein, 685 aa, Dengue Virus
MLNILNRRRRTAGIIIMMIPTVMAFHLTTRNGEPHMIVSRQEKGKSLLFKTEVGVNMCTLMAMDLGELCEDTITYKCPLLRQNEPEDIDCWCNSTSTWVTYGTCTTMGEHRREKRSVALVPHVGMGLETRTETWMSSEGAWKHVQRIETWILRHPGFTMMAAILAYTIGTTHFQRALILILLTAVTPSMTMRCIGMSNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFRCKKNMEGKVVQPENLEYTIVITPHSGEEHAVGNDTGKHGKEIKITPQSSITEAELTGYGTITMECSPRTGLDFNEIVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVTLVLVGIVTLYLGVMVQA

SEQ ID NO: 274 - protein, 685 aa, Dengue Virus
MLNILNRRRRTAGIIIMMIPTVMAFHLTTRNGEPHMIVSRQEKGKSLLFKTKDGTNMCTLMAMDLGELCEDTITYKCPFLKQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAIAPSMTMRCIGISNRDFVEGVSGGSWVDIVLEHGSCVTTMAKNKPTLDFELIKTEAKQPATLRKYCIEAKLTNTTTDSRCPTQGEPTLNEEQDKRFVCKHSMVDRGWGNGCGLFGKGGIVTCAMFTCKKNMEGKIVQPENLEYTVVITPHSGEEHAVGNDTGKHGKEVKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGAEPGQLKLDWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQA

SEQ ID NO: 275 - protein, 685 aa, Dengue Virus
MLNILNRRRRTAGIIIMMIPTVMAFHLTTRNGEPHMIVSRQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIEIWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFTCKKNMEGKVVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQA

SEQ ID NO: 276 - protein, 100 aa, Dengue Virus
MNNQRKKTGRPSFNMLKRARNRVSTVSQLAKRFSKGLLSGQGPMKLVMAFIAFLRFLAIPPTAGILARWGSFKKNGAIKVLRGFKKEISNMLNIMNRRKR

SEQ ID NO: 277 - protein, 100 aa, Dengue Virus
MNNQRKKTGKPSINMLKRVRNRVSTGSQLAKRFSKGLLNGQGPMKLVMAFIAFLRFLAIPPTAGVLARWGTFKKSGAIKVLKGFKKEISNMLSIINQRKK

SEQ ID NO: 278 - protein, 100 aa, Dengue Virus
MNNQRKKAKNTPFNMLKRERNRVSTVQQLTKRFSLGMLQGRGPLKLFMALVAFLRFLTIPPTAGILKRWGTIKKSKAINVLRGFRKEIGRMLNILNRRRR

SEQ ID NO: 279 - protein, 114 aa, Dengue Virus
MNNQRKKTGRPSFNMLKRARNRVSTVSQLAKRFSKGLLSGQGPMKLVMAFIAFLRFLAIPPTAGILARWGSFKKNGAIKVLRGFKKEISNMLNIMNRRKRSVTMLLMLLPTALA

SEQ ID NO: 280 - protein, 114 aa, Dengue Virus
MNNQRKKTGKPSINMLKRVRNRVSTGSQLAKRFSKGLLNGQGPMKLVMAFIAFLRFLAIPPTAGVLARWGTFKKSGAIKVLKGFKKEISNMLSIINQRKKTSLCLMMILPAALA

SEQ ID NO: 281 - protein, 114 aa, Dengue Virus
MNNQRKKAKNTPFNMLKRERNRVSTVQQLTKRFSLGMLQGRGPLKLFMALVAFLRFLTIPPTAGILKRWGTIKKSKAINVLRGFRKEIGRMLNILNRRRRSAGMIIMLIPTVMA

SEQ ID NO: 282 - protein, 113 aa, Dengue Virus
MNQRKKVVRPPFNMLKRERNRVSTPQGLVKRFSTGLFSGKGPLRMVLAFITFLRVLSIPPTAGILKRWGQLKKNKAIKILIGFRKEIGRMLNILNGRKRSTITLLCLIPTVMA

SEQ ID NO: 283 - protein, 99 aa, Dengue Virus
MNQRKKVVRPPFNMLKRERNRVSTPQGLVKRFSTGLFSGKGPLRMVLAFITFLRVLSIPPTAGILKRWGQLKKNKAIKILIGFRKEIGRMLNILNGRKR

SEQ ID NO: 284 - protein, 493 aa, Dengue Virus
MRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWASGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATERGARRMAILGDTAWDFGSVGGVLNSLGKMVHQIFGSAYTALFSGVSWVMKIGIGVLLTWIGLNSKNTSMSFSCIAIGIITLYLGAVVQA

SEQ ID NO: 285 - protein, 495 aa, Dengue Virus
MRCVGIGNRDFVEGLSGATWVDVVLEHGSCVTTMAKDKPTLDIELLKTEVTNPAVLRKLCIEAKISNTTTDSRCPTQGEATLVEEQDTNFVCRRTFVDRGWGNGCGLFGKGSLITCAKFKCVTKLEGKIVQYENLKYSVIVTVHTGDQHQVGNETTEHGTTATITPQAPTSEIQLTDYGALTLDCSPRTGLDFNEMVLLTMKKKSWLVHKQWFLDLPLPWTSGASTSQETWNRQDLLVTFKTAHAKKQEVVVLGSQEGAMHTALTGATEIQTSGTTTIFAGHLKCRLKMDKLILKGMSYVMCTGSFKLEKEVAETQHGTVLVQVKYEGTDAPCKIPFSSQDEKGVTQNGRLITANPIVTDKEKPVNIEAEPPFGESYIVVGAGEKALKLSWFKKGSSIGKMFEATARGARRMAILGDTAWDFGSIGGVFTSVGKLIHQIFGTAYGVLFSGVSWTMKIGIGILLTWLGLNSRSTSLSMTCIAVGMVTLYLGVMVQA

SEQ ID NO: 286 - protein, 495 aa, Dengue Virus
MRCIGMSNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFRCKKNMEGKVVQPENLEYTIVITPHSGEEHAVGNDTGKHGKEIKITPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVTLVLVGIVTLYLGVMVQA

SEQ ID NO: 287 - protein, 491 aa, Dengue Virus
MRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFSCSGKITGNLVRIENLEYTVVVTVHNGDTHAVGNDTSNHGVTAMITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCEVRMEKLRIKGMSYTMCSGKFSIDKEMAETQHGTTVVKVKYEGAGAPCKVPIEIRDVNKEKVVGRIISSTPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGF

SEQ ID NO: 288 - protein, 75 aa, Dengue Virus
SVALTPHSGMGLETRAETWMSSEGAWKHAQRVESWILRNPGFALLAGFMAYMIGQTGIQRTVFFVLMMLVAPSYG

SEQ ID NO: 289 - protein, 75 aa, Dengue Virus
SVALAPHVGMGLDTRTQTWMSAEGAWRQVEKVETWALRHPGFTILALFLAHYIGTSLTQKVVIFILLMLVTPSMT

SEQ ID NO: 290 - protein, 75 aa, Dengue Virus
SVALAPHVGLGLETRTETWMSSEGAWKQIQKVETWALRHPGFTVIALFLAHAIGTSITQKGIIFILLMLVTPSMA

SEQ ID NO: 291 - protein, 75 aa, Dengue Virus
SVALVPHVGMGLETRTETWMSSEGAWKHVQRIETWILRHPGFTMMAAILAYTIGTTHFQRALIFILLTAVTPSMT

SEQ ID NO: 292 - protein, 9 aa, Artificial Sequence
  Synthetic Polynucleotide
KTVWFVPSI

SEQ ID NO: 293 - protein, 9 aa, Artificial Sequence
  Synthetic Polynucleotide
TVWFVPSIK

SEQ ID NO: 294 - protein, 9 aa, Artificial Sequence
  Synthetic Polynucleotide
GQQRVFKEK

SEQ ID NO: 295 - protein, 9 aa, Artificial Sequence
  Synthetic Polynucleotide
CVYNMMGKR

SEQ ID NO: 296 - protein, 9 aa, Artificial Sequence
  Synthetic Polynucleotide
VYNMMGKRE

SEQ ID NO: 297 - protein, 9 aa, Artificial Sequence
  Synthetic Polynucleotide
YNMMGKREK

SEQ ID NO: 298 - protein, 9 aa, Artificial Sequence
  Synthetic Polynucleotide
NMMGKREKK

SEQ ID NO: 299 - protein, 9 aa, Artificial Sequence
  Synthetic Polynucleotide
GTYGLNTFT

SEQ ID NO: 300 - protein, 9 aa, Artificial Sequence
  Synthetic Polynucleotide
ISGDDCVVK

SEQ ID NO: 301 - protein, 9 aa, Artificial Sequence
  Synthetic Polynucleotide
LMCHATFTM

SEQ ID NO: 302 - protein, 9 aa, Artificial Sequence
  Synthetic Polynucleotide
CHATFTMRL

SEQ ID NO: 303 - protein, 9 aa, Artificial Sequence
  Synthetic Polynucleotide
GEAAAIFMT

SEQ ID NO: 304 - protein, 9 aa, Artificial Sequence
  Synthetic Polynucleotide
KTVWFVPSI

SEQ ID NO: 305 - protein, 9 aa, Artificial Sequence
  Synthetic Polynucleotide
HWTEAKMLL

SEQ ID NO: 306 - protein, 9 aa, Artificial Sequence
  Synthetic Polynucleotide
WTEAKMLLD

SEQ ID NO: 307 - protein, 9 aa, Artificial Sequence
  Synthetic Polynucleotide
LGCGRGGWS

SEQ ID NO: 308 - protein, 9 aa, Artificial Sequence
  Synthetic Polynucleotide
MAMTDTTPF

SEQ ID NO: 309 - protein, 9 aa, Artificial Sequence
  Synthetic Polynucleotide
MYADDTAGW

SEQ ID NO: 310 - protein, 9 aa, Artificial Sequence
  Synthetic Polynucleotide
VGTYGLNTF

SEQ ID NO: 311 - protein, 9 aa, Artificial Sequence
  Synthetic Polynucleotide
YFHRRDLRL

SEQ ID NO: 312 - protein, 9 aa, Artificial Sequence
  Synthetic Polynucleotide
FKPGTSGSP

SEQ ID NO: 313 - protein, 9 aa, Artificial Sequence
  Synthetic Polynucleotide
KPGTSGSPI

SEQ ID NO: 314 - protein, 9 aa, Artificial Sequence
  Synthetic Polynucleotide
IPERSWNSG

SEQ ID NO: 315 - protein, 9 aa, Artificial Sequence
  Synthetic Polynucleotide
PERVILAGP

SEQ ID NO: 316 - protein, 9 aa, Artificial Sequence
  Synthetic Polynucleotide
LMRRGDLPV

SEQ ID NO: 317 - protein, 9 aa, Artificial Sequence
  Synthetic Polynucleotide
PLSRNSTHE

SEQ ID NO: 318 - protein, 9 aa, Artificial Sequence
  Synthetic Polynucleotide
LSRNSTHEM

SEQ ID NO: 319 - protein, 9 aa, Artificial Sequence
  Synthetic Polynucleotide
SRNSTHEMY

SEQ ID NO: 320 - protein, 9 aa, Artificial Sequence
  Synthetic Polynucleotide
MAMTDTTPF

SEQ ID NO: 321 - protein, 9 aa, Artificial Sequence
  Synthetic Polynucleotide
TPFGQQRVF

SEQ ID NO: 322 - protein, 9 aa, Artificial Sequence
  Synthetic Polynucleotide
LMYFHRRDL

SEQ ID NO: 323 - protein, 9 aa, Artificial Sequence
  Synthetic Polynucleotide
LRTLILAPT

SEQ ID NO: 324 - protein, 9 aa, Artificial Sequence
  Synthetic Polynucleotide
LMCHATFTM

SEQ ID NO: 325 - protein, 9 aa, Artificial Sequence
  Synthetic Polynucleotide
ARGYISTRV

SEQ ID NO: 326 - protein, 9 aa, Artificial Sequence
  Synthetic Polynucleotide
RRGDLPVWL

SEQ ID NO: 327 - protein, 9 aa, Artificial Sequence
  Synthetic Polynucleotide
GQQRVFKEK

SEQ ID NO: 328 - protein, 9 aa, Artificial Sequence
  Synthetic Polynucleotide
SRAIWYMWL

SEQ ID NO: 329 - protein, 9 aa, Artificial Sequence
  Synthetic Polynucleotide
FKLTYQNKV

SEQ ID NO: 330 - protein, 9 aa, Artificial Sequence
  Synthetic Polynucleotide
FKPGTSGSP

SEQ ID NO: 331 - protein, 9 aa, Artificial Sequence
  Synthetic Polynucleotide
LAPTRVVAA

SEQ ID NO: 332 - protein, 9 aa, Artificial Sequence
  Synthetic Polynucleotide
LMCHATFTM

SEQ ID NO: 333 - protein, 9 aa, Artificial Sequence
  Synthetic Polynucleotide
CHATFTMRL

SEQ ID NO: 334 - protein, 9 aa, Artificial Sequence
  Synthetic Polynucleotide
HATFTMRLL

SEQ ID NO: 335 - protein, 9 aa, Artificial Sequence
  Synthetic Polynucleotide
ATFTMRLLS

SEQ ID NO: 336 - protein, 9 aa, Artificial Sequence
  Synthetic Polynucleotide
KTVWFVPSI

SEQ ID NO: 337 - protein, 9 aa, Artificial Sequence
  Synthetic Polynucleotide
LSRNSTHEM

SEQ ID NO: 338 - protein, 9 aa, Artificial Sequence
  Synthetic Polynucleotide
QQRVFKEKV

SEQ ID NO: 339 - protein, 9 aa, Artificial Sequence
  Synthetic Polynucleotide
YGLNTFTNM

SEQ ID NO: 340 - protein, 9 aa, Artificial Sequence
  Synthetic Polynucleotide
LMYFHRRDL

SEQ ID NO: 341 - protein, 9 aa, Artificial Sequence
  Synthetic Polynucleotide
KQWFLDLPL

SEQ ID NO: 342 - protein, 9 aa, Artificial Sequence
  Synthetic Polynucleotide
RQWFLDLPL

SEQ ID NO: 343 - protein, 9 aa, Artificial Sequence
  Synthetic Polynucleotide
RQWFFDLPL

SEQ ID NO: 344 - protein, 9 aa, Artificial Sequence
  Synthetic Polynucleotide
TALTGATEI

SEQ ID NO: 345 - protein, 167 aa, Artificial Sequence
  Synthetic Polynucleotide
MLESIINFEKLTEGGGGSGGGGSLESIINFEKLTEGGGGSGGGGSLESIINFEKLTEGGGGSGGGGSLESIINFEKLTEGGGGSGGGGSLESIINFEKLTEGGGGSGGGGSLESIINFEKLTEGGGGSGGGGSLESIINFEKLTEGGGGSGGGGSLESIINFEKLTE

SEQ ID NO: 346 - protein, 125 aa, Artificial Sequence
  Synthetic Polynucleotide
MLESIINFEKLTEGFLGLESIINFEKLTEGFLGLESIINFEKLTEGFLGLESIINFEKLTEGFLGLESIINFEKLTEGFLGLESIINFEKLTEGFLGLESIINFEKLTEGFLGLESIINFEKLTE

SEQ ID NO: 347 - protein, 177 aa, Artificial Sequence
  Synthetic Polynucleotide
MRVTAPRTVLLLLSAALALTETWALESIINFEKLTELESIINFEKLTELESIINFEKLTELESIINFEKLTELESIINFEKLTELESIINFEKLTELESIINFEKLTELESIINFEKLTEGSIVGIVAGLAVLAVVVIGAVVATVMCRRKSSGGKGGSYSQAASSDSAQGSDVSLTA

SEQ ID NO: 348 - protein, 205 aa, Artificial Sequence
  Synthetic Polynucleotide
MRVTAPRTVLLLLSAALALTETWALESIINFEKLTEGFLGLESIINFEKLTEGFLGLESIINFEKLTEGFLGLESIINFEKLTEGFLGLESIINFEKLTEGFLGLESIINFEKLTEGFLGLESIINFEKLTEGFLGLESIINFEKLTEGSIVGIVAGLAVLAVVVIGAVVATVMCRRKSSGGKGGSYSQAASSDSAQGSDVSLTA

SEQ ID NO: 349 - protein, 13 aa, Artificial Sequence
  Synthetic Polynucleotide
MSIINFEKLKDEL

SEQ ID NO: 350 - protein, 93 aa, Artificial Sequence
  Synthetic Polynucleotide
MRVTAPRTVLLLLSAALALTETWALESIINFEKLTEGSIVGIVAGLAVLAVVVIGAVVATVMCRRKSSGGKGGSYSQAASSDSAQGSDVSLTA

SEQ ID NO: 351 - protein, 113 aa, Artificial Sequence
  Synthetic Polynucleotide
METDTLLLWVLLLWVPGSTGDSIINFEKLGFLGSIINFEKLGFLGSIINFEKLGFLGSIINFEKLGFLGSIINFEKLGFLGSIINFEKLGFLGSIINFEKLGFLGSIINFEKL

SEQ ID NO: 352 - protein, 247 aa, Artificial Sequence
  Synthetic Polynucleotide
MRVTAPRTVLLLLSAALALTETWALESIINFEKLTEGGGGSGGGGSLESIINFEKLTEGGGGSGGGGSLESIINFEKLTEGGGGSGGGGSLESIINFEKLTEGGGGSGGGGSLESIINFEKLTEGGGGSGGGGSLESIINFEKLTEGGGGSGGGGSLESIINFEKLTEGGGGSGGGGSLESIINFEKLTEGSIVGIVAGLAVLAVVVIGAVVATVMCRRKSSGGKGGSYSQAASSDSAQGSDVSLTA

SEQ ID NO: 353 - protein, 97 aa, Artificial Sequence
  Synthetic Polynucleotide
MLESIINFEKLTELESIINFEKLTELESIINFEKLTELESIINFEKLTELESIINFEKLTELESIINFEKLTELESIINFEKLTELESIINFEKLTE

SEQ ID NO: 354 - protein, 9 aa, Artificial Sequence
  Synthetic Polynucleotide
MSIINFEKL

SEQ ID NO: 355 - protein, 134 aa, Artificial Sequence
  Synthetic Polynucleotide
METDTLLLWVLLLWVPGSTGDHPFTEDDAVDPNDSDIDPESRSIINFEKLGFLGSIINFEKLGFLGSIINFEKLGFLGSIINFEKLGFLGSIINFEKLGFLGSIINFEKLGFLGSIINFEKLGFLGSIINFEKL

SEQ ID NO: 356 - protein, 159 aa, Artificial Sequence
  Synthetic Polynucleotide
MSIINFEKLGFLGSIINFEKLGFLGSIINFEKLGFLGSIINFEKLGFLGSIINFEKLGFLGSIINFEKLGFLGSIINFEKLGFLGSIINFEKLPPPSTVSNMIIIEVLIVLGAVINIGAMVAFVLKSKRKIGGKGGVYALAGGSNSIHGSALFLEAFKA

SEQ ID NO: 357 - protein, 400 aa, Artificial Sequence
  Synthetic Polynucleotide
MRCVGIGNRDFVEGLSGATNVDVVLEHGSCVTTMAKDKPTLDIELLKTEVTNPAVLRKLCIEAKISNTTTDSRCPTQGEATLVEEQDANFVCRRTFVCRGAGNGCGLFGKGSLLTCAKFKCVTKLEGKIVQYENLKYSVIVTVHTGDQHQVGNETTEHGTIATITPQAPTSEIQLTDYGALTLDCSPRTGLDFNFMVLLTMKEKSWLVHKQWFLDLPLPWTSGASTSQETWNRQDLLVTFKTAHAKKQEAVVLGSQEGAMHTALTGATEIQTSGTTTIFAGHLKCRLKMDKLTLKGISYVMCTGSFKLEKEVAETQHGTVLVQVKYEGTDAPCKIPFSSQDEKGVTQNGRLVTANPIVTDKEKPVNIEAEPPFGESYIVVGAGEKALKLSWFKKGSSIGK

SEQ ID NO: 358 - protein, 394 aa, Artificial Sequence
  Synthetic Polynucleotide
MRCIGISNRDFVEGVSGGSNVDIVLEHGSCVTTMAKNKPTLDFELIKTEAKQPATLRKYCIEAKLTNTTTESRCPTQGEPTLNEEQDKRFVCKHSMVDRGWGNGCGLFGKGGIVTCAMFTCKKNMEGKIVQPENLEYTVVITPHSGEEHAVGNDTGKHGKEVKITPQSSITEAELTGYGTVTMECSPRTGLDFNFMVLLQMKDKAWLVHRQWFLDLPLPWLPGADTQGSNWIQKETLVTFKNPHAKKQDVVVLGSQEGAMHTALTGATEIQMSSGNLLFTGHLKCALRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPDQLKLNWFKK

SEQ ID NO: 359 - protein, 392 aa, Artificial Sequence
  Synthetic Polynucleotide
MRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLESIEGKIVQHENLKYTVIITVHTGDQHQVGNETQGVTAEITSQASTAEAILPEYGTLGLECSPRTGLDFNEMILLTMKDKAWMVHRQWFFDLPLPWTSGATTKTPTWNRKELLVTFKNAHAKKQEVVVLGSQEGAMHTALTGATEIQTSGGTSIFAGHLKCRLKMDKLKLKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYRK

SEQ ID NO: 360 - protein, 400 aa, Artificial Sequence
  Synthetic Polynucleotide
MRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTAMITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRIISSTPLAENTNSVTNIELEPPFGDSYIVIGVGNSALTLHWFRKGSSIGK

SEQ ID NO: 361 - protein, 140 aa, Artificial Sequence
  Synthetic Polynucleotide
GKPIPNPLLGLDSTGFLGGKPIPNPLLGLDSTGFLGGKPIPNPLLGLDSTGFLGGKPIPNPLLGLDSTGFLGGKPIPNPLLGLDSTGFLGGKPIPNPLLGLDSTGFLGGKPIPNPLLGLDSTGFLGGKPIPNPLLGLDST

SEQ ID NO: 362 - protein, 140 aa, Artificial Sequence; identical to SEQ ID NO: 361
  Synthetic Polynucleotide

SEQ ID NO: 363 - protein, 8 aa, Artificial Sequence
  Synthetic Polynucleotide
TALGATEI

SEQ ID NO: 364 - protein, 8 aa, Artificial Sequence
  Synthetic Polynucleotide
SIINFEKL

SEQ ID NO: 365 - protein, 9 aa, Dengue Virus
  misc_feature (2)..(2): Xaa can be Ala or Ser or Thr
  misc_feature (4)..(4): Xaa can be Leu or Met
  misc_feature (7)..(7): Xaa can be Lys or Arg
KXWXVHXQW

SEQ ID NO: 366 - protein, 9 aa, Dengue Virus
  misc_feature (3)..(3): Xaa can be Thr or Ser or Val or Ser
  misc_feature (6)..(6): Xaa can be Leu or Thr or Ser
  misc_feature (7)..(7): Xaa can be Asn or Gly
  misc_feature (8)..(8): Xaa can be Lys or Ser or Thr
SYXMCXXXF

SEQ ID NO: 367 - protein, 9 aa, Dengue Virus
  misc_feature (5)..(5): Xaa can be Asn or Thr or Val
  misc_feature (6)..(6): Xaa can be Ala or Pro
VTFKXXHAK

SEQ ID NO: 368 - protein, 9 aa, Dengue Virus
  misc_feature (1)..(1): Xaa can be Lys or Arg
  misc_feature (5)..(5): Xaa can be Leu or Phe
XQWFXDLPL

SEQ ID NO: 369 - protein, 9 aa, Dengue Virus
  misc_feature (1)..(1): Xaa can be Ala or Gln
  misc_feature (3)..(3): Xaa can be Lys or Thr
  misc_feature (4)..(4): Xaa can be Leu or Tyr
  misc_feature (5)..(5): Xaa can be His or Ser or Asn
  misc_feature (7)..(7): Xaa can be Phe or Tyr
  misc_feature (8)..(8): Xaa can be Lys or Arg
XLXXXWXXK

SEQ ID NO: 370 - protein, 9 aa, Dengue Virus
GWGNGCGLF

SEQ ID NO: 371 - protein, 15 aa, Dengue Virus
  misc_feature (1)..(1): Xaa can be Asp or Glu
  misc_feature (3)..(3): Xaa can be Asn or Tyr
  misc_feature (5)..(6): Xaa can be Ile or Val
  misc_feature (8)..(8): Xaa can be Val or Ile or Ala
  misc_feature (9)..(9): Xaa can be Glu or Gly
  misc_feature (10)..(10): Xaa can be Pro or Asn or Glu or Asp
  misc_feature (11)..(11): Xaa can be Gly or Lys or Ser
  misc_feature (12)..(12): Xaa can be Gln or Ala
  misc_feature (14)..(14): Xaa can be Thr or Lys
  misc_feature (15)..(15): Xaa can be Ile or Leu
XSXIXXGXXXXXLXX

SEQ ID NO: 372 - protein, 15 aa, Dengue Virus
  misc_feature (4)..(4): Xaa can be Val or Ile
  misc_feature (6)..(6): Xaa can be Leu or Met
  misc_feature (7)..(7): Xaa can be Gln or Thr or Lys
  misc_feature (10)..(10): Xaa can be Asp or Glu or Lys
  misc_feature (12)..(12): Xaa can be Ala or Ser or Thr
  misc_feature (14)..(14): Xaa can be Met or Leu
NEMXLXXMKXKXWXV

SEQ ID NO: 373 - protein, 15 aa, Dengue Virus
  misc_feature (2)..(2): Xaa can be Leu or Met
  misc_feature (5)..(5): Xaa can be Arg or Lys
  misc_feature (9)..(9): Xaa can be Phe or Leu
WXVHXQWFXDLPLPW

SEQ ID NO: 374 - protein, 15 aa, Dengue Virus
  misc_feature (1)..(1): Xaa can be Asn or Ile
  misc_feature (2)..(2): Xaa can be Gln or Arg or Tyr
  misc_feature (3)..(3): Xaa can be Lys or Gln
  misc_feature (4)..(4): Xaa can be Glu or Asp
  misc_feature (5)..(5): Xaa can be Thr or Leu or Arg
  misc_feature (6)..(6): Xaa can be Met or Leu
  misc_feature (11)..(11): Xaa can be Glu or Thr or Val
  misc_feature (12)..(12): Xaa can be Pro or Ala
XXXXXXVTFKXXHAK

SEQ ID NO: 375 - protein, 15 aa, Dengue Virus
  misc_feature (3)..(3): Xaa can be Lys or Arg
  misc_feature (4)..(4): Xaa can be Val or Leu
  misc_feature (5)..(5): Xaa can be Arg or Lys
  misc_feature (7)..(7): Xaa can be Glu or Asp
  misc_feature (10)..(10): Xaa can be Gln or Lys or Thr or Arg
  misc_feature (11)..(11): Xaa can be Ile or Leu
  misc_feature (14)..(14): Xaa can be Met or Ile
KCXXXMXKLXXKGXS

SEQ ID NO: 376 - DNA, 1537 bp, Chikungunya Virus
tcaagcttttggaccctcgtacagaagctaatacgactcactatagggaaataagagagaaaagaagagtaagaagaaatataagagccaccatggagacacctgcacagctgttgtttctgctgctgctttggttgcccgataccaccggtgactacaaagacgacgacgataaatacgagcacgtgacggtaataccaaacactgtgggggtgccatacaagaccctggtaaatcgcccaggctactctcccatggtgctggagatggagctccagtctgtgaccttagagccaaccctctcactcgactatatcacctgtgaatacaaaacagtgatcccatccccctacgtgaaatgttgcggaactgcagagtgtaaggataagagtctgcccgattacagctgcaaggtgtttacaggcgtgtatccatttatgtggggaggagcctactgtttttgcgatgccgaaaatactcagctgtctgaagcccatgtggagaagagtgaaagttgcaagaccgaatttgctagtgcctacagggcacacaccgcttctgcctccgctaaactccgagtcctttaccagggcaataatattacggtcgctgcctacgctaacggggaccacgctgtgacagtcaaggacgccaaattcgtagtgggcccaatgagctccgcctggactcccttcgacaacaaaatcgtcgtgtataaaggcgacgtgtacaatatggactacccacccttcggggctggaagaccgggccagtttggagatatccaatcaaggacacccgagtcaaaggacgtgtacgccaatacgcagctggtgctgcagagacccgccgctggtaccgtgcatgtgccttattcccaagctccatctggcttcaagtactggttgaaagagcgcggtgcttcgctgcagcatacagcaccgttcggatgtcagatagcaaccaaccctgtacgggctgtcaactgtgccgtgggaaatatacctatttccatcgacattccggacgcagctttcacacgtgtcgttgatgccccctcagtgactgacatgtcatgtgaggtgcctgcttgcacccacagcagcgattttggcggagtggccataatcaagtacaccgcctccaaaaaaggaaagtgtgccgtacactctatgaccaacgccgtcacaatcagagaagccgacgttgaagtagagggaaattcacagctgcaaatcagcttcagcaccgctcttgcctctgctgagtttagggttcaggtttgcagtactcaggtgcactgtgcagccgcttgccatccccccaaggatcatatcgtgaattatcctgcatcccacaccacactgggagtccaggatatctcaacaactgcaatgtcttgggtgcagaagatcacctgataataggctggagcctcggtggccatgcttcttgccccttgggcctccccccagcccctcctccccttcctgcacccgtacccccgtggtctttgaataaagtctgagtgggcggc

SEQ ID NO: 377 - DNA, 1531 bp, Chikungunya Virus
tcaagcttttggaccctcgtacagaagctaatacgactcactatagggaaataagagagaaaagaagagtaagaagaaatataagagccaccatgtacgaacacgtaacagtgatcccgaacacggtgggagtaccgtataagactctagtcaacagaccgggctacagccccatggtattggagatggagcttctgtctgtcaccttggaaccaacgctatcgcttgattacatcacgtgcgagtataaaaccgttatcccgtctccgtacgtgaaatgctgcggtacagcagagtgtaaggacaagagcctacctgattacagctgtaaggtcttcaccggcgtctacccattcatgtggggcggcgcctactgcttctgcgacaccgaaaatacgcaattgagcgaagcacatgtggagaagtccgaatcatgcaaaacagaatttgcatcagcatacagggctcataccgcatccgcatcagctaagctccgcgtcctttaccaaggaaataatatcactgtggctgcttatgcaaacggcgaccatgccgtcacagttaaggacgctaaattcatagtggggccaatgtcttcagcctggacacctttcgacaataaaatcgtggtgtacaaaggcgacgtctacaacatggactacccgcccttcggcgcaggaagaccaggacaatttggcgacatccaaagtcgcacgcctgagagcgaagacgtctatgctaatacacaactggtactgcagagaccgtccgcgggtacggtgcacgtgccgtactctcaggcaccatctggcttcaagtattggctaaaagaacgaggggcgtcgctgcagcacacagcaccatttggctgtcaaatagcaacaaacccggtaagagcgatgaactgcgccgtagggaacatgcctatctccatcgacataccggacgcggcctttaccagggtcgtcgacgcgccatctttaacggacatgtcgtgtgaggtatcagcctgcacccattcctcagactttgggggcgtagccatcattaaatatgcagccagtaagaaaggcaagtgtgcagtgcactcgatgactaacgccgtcactattcgggaagctgaaatagaagtagaagggaactctcagttgcaaatctctttttcgacggccctagccagcgccgaatttcgcgtacaagtctgttctacacaagtacactgtgcagccgagtgccatccaccgaaagaccatatagtcaattacccggcgtcacacaccaccctcggggtccaagacatttccgctacggcgatgtcatgggtgcagaagatcacgggaggtgtgggactggttgtcgctgttgcagcactgatcctaatcgtggtgctatgcgtgtcgtttagcaggcactgataataggctggagcctcggtggccatgcttcttgccccttgggcctccccccagcccctcctccccttcctgcacccgtacccccgtggtctttgaataaagtctgagtgggcggc

SEQ ID NO: 378 - DNA, 1690 bp, Chikungunya Virus
tcaagcttttggaccctcgtacagaagctaatacgactcactatagggaaataagagagaaaagaagagtaagaagaaatataagagccaccatgctatggaacgaacagcagcccctgttctggttgcaggctcttatcccgctggccgccttgatcgtcctgtgcaactgtctgaaactcttgccatgctgctgtaagaccctggcttttttagccgtaatgagcatcggtgcccacactgtgagcgcgtacgaacacgtaacagtgatcccgaacacggtgggagtaccgtataagactcttgtcaacagaccgggttacagccccatggtgttggagatggagctacaatcagtcaccttggaaccaacactgtcacttgactacatcacgtgcgagtacaaaactgtcatcccctccccgtacgtgaagtgctgtggtacagcagagtgcaaggacaagagcctaccagactacagctgcaaggtctttactggagtctacccatttatgtggggcggcgcctactgcttttgcgacgccgaaaatacgcaattgagcgaggcacatgtagagaaatctgaatcttgcaaaacagagtttgcatcggcctacagagcccacaccgcatcggcgtcggcgaagctccgcgtcctttaccaaggaaacaacattaccgtagctgcctacgctaacggtgaccatgccgtcacagtaaaggacgccaagtttgtcgtgggcccaatgtcctccgcctggacaccttttgacaacaaaatcgtggtgtacaaaggcgacgtctacaacatggactacccaccttttggcgcaggaagaccaggacaatttggtgacattcaaagtcgtacaccggaaagtaaagacgtttatgccaacactcagttggtactacagaggccagcagcaggcacggtacatgtaccatactctcaggcaccatctggcttcaagtattggctgaaggaacgaggagcatcgctacagcacacggcaccgttcggttgccagattgcgacaaacccggtaagagctgtaaattgcgctgtggggaacataccaatttccatcgacataccggatgcggcctttactagggttgtcgatgcaccctctgtaacggacatgtcatgcgaagtaccagcctgcactcactcctccgactttgggggcgtcgccatcatcaaatacacagctagcaagaaaggtaaatgtgcagtacattcgatgaccaacgccgttaccattcgagaagccgacgtagaagtagaggggaactcccagctgcaaatatccttctcaacagccctggcaagcgccgagtttcgcgtgcaagtgtgctccacacaagtacactgcgcagccgcatgccaccctccaaaggaccacatagtcaattacccagcatcacacaccacccttggggtccaggatatatccacaacggcaatgtcttgggtgcagaagattacgggaggagtaggattaattgttgctgttgctgccttaattttaattgtggtgctatgcgtgtcgtttagcaggcactaatgataataggctggagcctcggtggccatgcttcttgccccttgggcctccccccagcccctcctccccttcctgcacccgtacccccgtggtctttgaataaagtctgagtgggcggc

SEQ ID NO: 379 - DNA, 1531 bp, Chikungunya Virus
tcaagcttttggaccctcgtacagaagctaatacgactcactatagggaaataagagagaaaagaagagtaagaagaaatataagagccaccatgtacgaacacgtaacagtgatcccgaacacggtgggagtaccgtataagactctagtcaatagaccgggctacagtcccatggtattggagatggaactactgtcagtcactttggagccaacgctatcgcttgattacatcacgtgcgagtacaaaaccgttatcccgtctccgtacgtgaaatgctgcggtacagcagagtgcaaggacaaaaacctacctgactacagctgtaaggtcttcaccggcgtctacccatttatgtggggcggagcctactgcttctgcgacgctgaaaacacgcaattgagcgaagcacacgtggagaagtccgaatcatgcaaaacagaatttgcatcagcatacagggctcataccgcatccgcatcagctaagctccgcgtcctttaccaaggaaataacatcactgtaactgcctatgctaacggcgaccatgccgtcacagttaaggacgccaaattcattgtggggccaatgtcttcagcctggacacctttcgacaacaaaattgtggtgtacaaaggtgacgtctataacatggactacccgccctttggcgcaggaagaccaggacaatttggcgatatccaaagtcgcacacctgagagtaaagacgtctatgctaatacacaactggtactgcagagaccggctgcgggtacggtacatgtgccatactctcaggcaccatctggctttaagtattggctaaaagaacgaggggcgtcgctgcagcacacagcaccatttggctgccaaatagcaacaaacccggtaagagcggtgaattgcgccgtagggaacatgcccatctccatcgacataccggatgcggccttcattagggtcgtcgacgcgccctctttaacggacatgtcgtgcgaggtaccagcctgcacccattcctcagatttcgggggcgtcgccattattaaatatgcagccagcaagaaaggcaagtgtgcggtgcattcgatgaccaacgccgtcacaattcgggaagctgagatagaagttgaagggaattctcagctgcaaatctctttctcgacggccttggccagcgccgaattccgcgtacaagtctgttctacacaagtacactgtgtagccgagtgccaccctccgaaggaccacatagtcaattacccggcgtcacataccaccctcggggtccaggacatttccgctacggcgctgtcatgggtgcagaagatcacgggaggcgtgggactggttgtcgctgttgcagcactgattctaatcgtggtgctatgcgtgtcgttcagcaggcactgataataggctggagcctcggtggccatgcttcttgccccttgggcctccccccagcccctcctccccttcctgcacccgtacccccgtggtctttgaataaagtctgagtgggcggc

SEQ ID NO: 380 - DNA, 1340 bp, Chikungunya Virus
atggagaccccagctcagcttctgtttcttctccttctatggctgcctgacacgactggacatcaccaccatcatcatagtacaaaagacaatttcaatgtgtacaaggccacccgcccttatttagcacactgtccagattgcggtgaggggcactcctgtcactctcctatcgccttggagcggatccggaatgaggcgaccgatggaacactgaaaatccaggtaagcttgcagattggcatcaagactgacgatagccatgattggaccaaactacggtatatggatagccatacacctgccgatgctgaacgggccggtctgcttgtgagaactagcgctccatgcaccatcacggggacaatgggacattttatcctggctagatgcccaaagggcgaaaccctcaccgtcggattcaccgactcaaggaaaatttctcacacatgtacccatcccttccaccatgagccaccggtgatcgggcgcgaacgcttccacagcaggcctcagcatggaaaagaactgccatgctcgacctatgtacagtccaccgccgctaccgccgaagagatcgaagtgcatatgcctcccgacacacccgaccgaaccctaatgacacaacaatctgggaatgtgaagattacagtcaatggacagactgtgaggtataagtgtaactgcggtggctcaaatgagggcctcaccacaacggataaggtgatcaataactgcaaaattgaccagtgtcacgcggccgtgaccaaccataagaactggcagtacaactcacccttagtgcctaggaacgctgagctgggagatcgcaaggggaagatacacattcccttcccgttggcgaatgtgacctgccgtgtgccaaaagcgagaaatcctaccgtaacatatggcaaaaatcaggtgaccatgttgctctacccggatcacccaactctgctgagctatcggaatatgggacaagaacccaattaccacgaggaatgggttacgcacaagaaagaggtgacccttacagtccctactgaaggtctggaagtgacctggggcaataacgagccttataagtactggccccagatgagtacaaacggcaccgcccatggacatccacacgagatcattctgtattactacgaactatatcccacaatgactggcaagcctataccaaacccacttctcggccttgatagcacatgataataggctggagcctcggtggccatgcttcttgccccttgggcctccccccagcccctcctccccttcctgcacccgtacccccgtggtctttgaataaagtctgagtgggcggc

SEQ ID NO: 381 - DNA, 1483 bp, Chikungunya Virus
tcaagcttttggaccctcgtacagaagctaatacgactcactatagggaaataagagagaaaagaagagtaagaagaaatataagagccaccatgagtaccaaggacaacttcaatgtctataaagccacaagaccgtacttagctcactgtcccgactgtggagaagggcactcgtgccatagtcccgtagcattagaacgcatcagaaatgaagcgacagacgggacgctgaaaatccaggtctccttgcaaatcggaataaagacggatgatagccacgattggaccaagctgcgttacatggacaaccacacgccagcggacgcagagagggcggggctatttgtaagaacatcagcaccgtgcacgattactggaacaatgggacacttcatcctgacccgatgtccgaaaggggaaactctgacggtgggattcactgacagtaggaagatcagtcactcatgtacgcacccatttcaccacgaccctcctgtgataggccgggagaaattccattcccgaccgcagcacggtaaagagctgccttgcagcacgtacgtgcagagcaccgccgcaactaccgaggagatagaggtacacatgcccccagacacccctgatcgcacattgatgtcacaacagtccggcaacgtaaagatcacagttaatggccagacggtgcggtacaagtgtaattgcggtggctcaaatgaaggactaataactacagacaaagtgattaataactgcaaagttgatcaatgtcatgccgcggtcaccaatcacaaaaagtggcagtacaactcccctctggtcccgcgtaatgctgaacttggggaccgaaaaggaaaaatccacatcccgtttccgctggcaaatgtaacatgcagggtgcctaaagcaaggaaccccaccgtgacgtacgggaaaaaccaagtcatcatgctactgtatcccgaccacccaacactcctgtcctaccggaacatgggagaagaaccaaactaccaagaagagtgggtgacgcataagaaggaagtcgtgctaaccgtgccgactgaagggctcgaggtcacgtggggtaacaacgagccgtataagtattggccgcagttatctacaaacggtacagcccatggccacccgcatgagataattctgtattattatgagctgtaccctactatgactgtagtagttgtgtcagtggcctcgttcgtactcctgtcgatggtgggtgtggcagtggggatgtgcatgtgtgcacgacgcagatgcatcacaccgtacgaactgacaccaggagctaccgtccctttcctgcttagcctaatatgctgcatcagaacagctaaagcgtgataataggctggagcctcggtggccatgcttcttgccccttgggcctccccccagcccctcctccccttcctgcacccgtacccccgtggtctttgaataaagtctgagtgggcggc

SEQ ID NO: 382 - DNA, 1483 bp, Chikungunya Virus
tcaagcttttggaccctcgtacagaagctaatacgactcactatagggaaataagagagaaaagaagagtaagaagaaatataagagccaccatgagtattaaggaccacttcaatgtctataaagccacaagaccgtacctagctcactgtcccgactgtggagaagggcactcgtgccatagtcccgtagcgctagaacgcatcagaaacgaagcgacagacgggacgttgaaaatccaggtttccttgcaaatcggaataaagacggatgatagccatgattggaccaagctgcgttatatggacaatcacatgccagcagacgcagagcgggccgggctatttgtaagaacgtcagcaccgtgcacgattactggaacaatgggacacttcattctggcccgatgtccgaaaggagaaactctgacggtggggttcactgacggtaggaagatcagtcactcatgtacgcacccatttcaccatgaccctcctgtgataggccgggaaaaattccattcccgaccgcagcacggtagggaactaccttgcagcacgtacgcgcagagcaccgctgcaactgccgaggagatagaggtacacatgcccccagacaccccagatcgcacattaatgtcacaacagtccggcaatgtaaagatcacagtcaatagtcagacggtgcggtacaagtgcaattgtggtgactcaagtgaaggattaaccactacagataaagtgattaataactgcaaggtcgatcaatgccatgccgcggtcaccaatcacaaaaaatggcagtataactcccctctggtcccgcgtaatgctgaattcggggaccggaaaggaaaagttcacattccatttcctctggcaaatgtgacatgcagggtgcctaaagcaagaaaccccaccgtgacgtacggaaaaaaccaagtcatcatgttgctgtatcctgaccacccaacgctcctgtcctacaggaatatgggagaagaaccaaactatcaagaagagtgggtgacgcataagaaggagatcaggttaaccgtgccgactgaggggctcgaggtcacgtggggtaacaatgagccgtacaagtattggccgcagttatccacaaacggtacagcccacggccacccgcatgagataattctgtattattatgagctgtacccaactatgactgcggtagttttgtcagtggcctcgttcatactcctgtcgatggtgggtgtggcagtggggatgtgcatgtgtgcacgacgcagatgcattacaccgtacgaactgacaccaggagctaccgtccctttcctgcttagcctaatatgctgcattagaacagctaaagcgtgataataggctggagcctcggtggccatgcttcttgccccttgggcctccccccagcccctcctccccttcctgcacccgtacccccgtggtctttgaataaagtctgagtgggcggc

SEQ ID NO: 383 - DNA, 1426 bp, Chikungunya Virus
tcaagcttttggaccctcgtacagaagctaatacgactcactatagggaaataagagagaaaagaagagtaagaagaaatataagagccaccatgccatatctagctcattgtcctgactgcggagaagggcattcgtgccacagccctatcgcattggagcgcatcagaaatgaagcaacggacggaacgctgaaaatccaggtctctttgcagatcgggataaagacagatgacagccacgattggaccaagctgcgctatatggatagccatacgccagcggacgcggagcgagccggattgcttgtaaggacttcagcaccgtgcacgatcaccgggaccatgggacactttattctcgcccgatgcccgaaaggagagacgctgacagtgggatttacggacagcagaaagatcagccacacatgcacacacccgttccatcatgaaccacctgtgataggtagggagaggttccactctcgaccacaacatggtaaagagttaccttgcagcacgtacgtgcagagcaccgctgccactgctgaggagatagaggtgcatatgcccccagatactcctgaccgcacgctgatgacgcagcagtctggcaacgtgaagatcacagttaatgggcagacggtgcggtacaagtgcaactgcggtggctcaaacgagggactgacaaccacagacaaagtgatcaataactgcaaaattgatcagtgccatgctgcagtcactaatcacaagaattggcaatacaactcccctttagtcccgcgcaacgctgaactcggggaccgtaaaggaaagatccacatcccattcccattggcaaacgtgacttgcagagtgccaaaagcaagaaaccctacagtaacttacggaaaaaaccaagtcaccatgctgctgtatcctgaccatccgacactcttgtcttaccgtaacatgggacaggaaccaaattaccacgaggagtgggtgacacacaagaaggaggttaccttgaccgtgcctactgagggtctggaggtcacttggggcaacaacgaaccatacaagtactggccgcagatgtctacgaacggtactgctcatggtcacccacatgagataatcttgtactattatgagctgtaccccactatgactgtagtcattgtgtcggtggcctcgttcgtgcttctgtcgatggtgggcacagcagtgggaatgtgtgtgtgcgcacggcgcagatgcattacaccatatgaattaacaccaggagccactgttcccttcctgctcagcctgctatgctgctgataataggctggagcctcggtggccatgcttcttgccccttgggcctccccccagcccctcctccccttcctgcacccgtacccccgtggtctttgaataaagtctgagtgggcggc

SEQ ID NO: 384 - DNA, 2800 bp, Chikungunya Virus
tcaagcttttggaccctcgtacagaagctaatacgactcactatagggaaataagagagaaaagaagagtaagaagaaatataagagccaccatgagtaccaaggacaacttcaatgtctataaagccacaagaccgtacttagctcactgtcccgactgtggagaagggcactcgtgccatagtcccgtagcattagaacgcatcagaaatgaagcgacagacgggacgctgaaaatccaggtctccttgcaaatcggaataaagacggatgatagccacgattggaccaagctgcgttacatggacaaccacacgccagcggacgcagagagggcggggctatttgtaagaacatcagcaccgtgcacgattactggaacaatgggacacttcatcctgacccgatgtccgaaaggggaaactctgacggtgggattcactgacagtaggaagatcagtcactcatgtacgcacccatttcaccacgaccctcctgtgataggccgggagaaattccattcccgaccgcagcacggtaaagagctgccttgcagcacgtacgtgcagagcaccgccgcaactaccgaggagatagaggtacacatgcccccagacacccctgatcgcacattgatgtcacaacagtccggcaacgtaaagatcacagttaatggccagacggtgcggtacaagtgtaattgcggtggctcaaatgaaggactaataactacagacaaagtgattaataactgcaaagttgatcaatgtcatgccgcggtcaccaatcacaaaaagtggcagtacaactcccctctggtcccgcgtaatgctgaacttggggaccgaaaaggaaaaatccacatcccgtttccgctggcaaatgtaacatgcagggtgcctaaagcaaggaaccccaccgtgacgtacgggaaaaaccaagtcatcatgctactgtatcccgaccacccaacactcctgtcctaccggaacatgggagaagaaccaaactaccaagaagagtgggtgacgcataagaaggaagtcgtgctaaccgtgccgactgaagggctcgaggtcacgtggggtaacaacgagccgtataagtattggccgcagttatctacaaacggtacagcccatggccacccgcatgagataattctgtattattatgagctgtaccctactatgactgtagtagttgtgtcagtggcctcgttcgtactcctgtcgatggtgggtgtggcagtggggatgtgcatgtgtgcacgacgcagatgcatcacaccgtacgaactgacaccaggagctaccgtccctttcctgcttagcctaatatgctgcatcagaacagctaaagcgtacgaacacgtaacagtgatcccgaacacggtgggagtaccgtataagactctagtcaatagaccgggctacagtcccatggtattggagatggaactactgtcagtcactttggagccaacgctatcgcttgattacatcacgtgcgagtacaaaaccgttatcccgtctccgtacgtgaaatgctgcggtacagcagagtgcaaggacaaaaacctacctgactacagctgtaaggtcttcaccggcgtctacccatttatgtggggcggagcctactgcttctgcgacgctgaaaacacgcaattgagcgaagcacacgtggagaagtccgaatcatgcaaaacagaatttgcatcagcatacagggctcataccgcatccgcatcagctaagctccgcgtcctttaccaaggaaataacatcactgtaactgcctatgctaacggcgaccatgccgtcacagttaaggacgccaaattcattgtggggccaatgtcttcagcctggacacctttcgacaacaaaattgtggtgtacaaaggtgacgtctataacatggactacccgccctttggcgcaggaagaccaggacaatttggcgatatccaaagtcgcacacctgagagtaaagacgtctatgctaatacacaactggtactgcagagaccggctgcgggtacggtacatgtgccatactctcaggcaccatctggctttaagtattggctaaaagaacgaggggcgtcgctgcagcacacagcaccatttggctgccaaatagcaacaaacccggtaagagcggtgaattgcgccgtagggaacatgcccatctccatcgacataccggatgcggccttcattagggtcgtcgacgcgccctctttaacggacatgtcgtgcgaggtaccagcctgcacccattcctcagatttcgggggcgtcgccattattaaatatgcagccagcaagaaaggcaagtgtgcggtgcattcgatgaccaacgccgtcacaattcgggaagctgagatagaagttgaagggaattctcagctgcaaatctctttctcgacggccttggccagcgccgaattccgcgtacaagtctgttctacacaagtacactgtgtagccgagtgccaccctccgaaggaccacatagtcaattacccggcgtcacataccaccctcggggtccaggacatttccgctacggcgctgtcatgggtgcagaagatcacgggaggcgtgggactggttgtcgctgttgcagcactgattctaatcgtggtgctatgcgtgtcgttcagcaggcactgataataggctggagcctcggtggccatgcttcttgccccttgggcctccccccagcccctcctccccttcctgcacccgtacccccgtggtctttgaataaagtctgagtgggcggc

SEQ ID NO: 385 - DNA, 5389 bp, Chikungunya Virus
tcaagcttttggaccctcgtacagaagctaatacgactcactatagggaaataagagagaaaagaagagtaagaagaaatataagagccaccatgagtattaaggaccacttcaatgtctataaagccacaagaccgtacctagctcactgtcccgactgtggagaagggcactcgtgccatagtcccgtagcgctagaacgcatcagaaacgaagcgacagacgggacgttgaaaatccaggtttccttgcaaatcggaataaagacggatgatagccatgattggaccaagctgcgttatatggacaatcacatgccagcagacgcagagcgggccgggctatttgtaagaacgtcagcaccgtgcacgattactggaacaatgggacacttcattctggcccgatgtccgaaaggagaaactctgacggtggggttcactgacggtaggaagatcagtcactcatgtacgcacccatttcaccatgaccctcctgtgataggccgggaaaaattccattcccgaccgcagcacggtagggaactaccttgcagcacgtacgcgcagagcaccgctgcaactgccgaggagatagaggtacacatgcccccagacaccccagatcgcacattaatgtcacaacagtccggcaatgtaaagatcacagtcaatagtcagacggtgcggtacaagtgcaattgtggtgactcaagtgaaggattaaccactacagataaagtgattaataactgcaaggtcgatcaatgccatgccgcggtcaccaatcacaaaaaatggcagtataactcccctctggtcccgcgtaatgctgaattcggggaccggaaaggaaaagttcacattccatttcctctggcaaatgtgacatgcagggtgcctaaagcaagaaaccccaccgtgacgtacggaaaaaaccaagtcatcatgttgctgtatcctgaccacccaacgctcctgtcctacaggaatatgggagaagaaccaaactatcaagaagagtgggtgacgcataagaaggagatcaggttaaccgtgccgactgaggggctcgaggtcacgtggggtaacaatgagccgtacaagtattggccgcagttatccacaaacggtacagcccacggccacccgcatgagataattctgtattattatgagctgtacccaactatgactgcggtagttttgtcagtggcctcgttcatactcctgtcgatggtgggtgtggcagtggggatgtgcatgtgtgcacgacgcagatgcattacaccgtacgaactgacaccaggagctaccgtccctttcctgcttagcctaatatgctgcattagaacagctaaagcgtacgaacacgtaacagtgatcccgaacacggtgggagtaccgtataagactctagtcaacagaccgggctacagccccatggtattggagatggagcttctgtctgtcaccttggaaccaacgctatcgcttgattacatcacgtgcgagtataaaaccgttatcccgtctccgtacgtgaaatgctgcggtacagcagagtgtaaggacaagagcctacctgattacagctgtaaggtcttcaccggcgtctacccattcatgtggggcggcgcctactgcttctgcgacaccgaaaatacgcaattgagcgaagcacatgtggagaagtccgaatcatgcaaaacagaatttgcatcagcatacagggctcataccgcatccgcatcagctaagctccgcgtcctttaccaaggaaataatatcactgtggctgcttatgcaaacggcgaccatgccgtcacagttaaggacgctaaattcatagtggggccaatgtcttcagcctggacacctttcgacaataaaatcgtggtgtacaaaggcgacgtctacaacatggactacccgcccttcggcgcaggaagaccaggacaatttggcgacatccaaagtcgcacgcctgagagcgaagacgtctatgctaatacacaactggtactgcagagaccgtccgcgggtacggtgcacgtgccgtactctcaggcaccatctggcttcaagtattggctaaaagaacgaggggcgtcgctgcagcacacagcaccatttggctgtcaaatagcaacaaacccggtaagagcgatgaactgcgccgtagggaacatgcctatctccatcgacataccggacgcggcctttaccagggtcgtcgacgcgccatctttaacggacatgtcgtgtgaggtatcagcctgcacccattcctcagactttgggggcgtagccatcattaaatatgcagccagtaagaaaggcaagtgtgcagtgcactcgatgactaacgccgtcactattcgggaagctgaaatagaagtagaagggaactctcagttgcaaatctctttttcgacggccctagccagcgccgaatttcgcgtacaagtctgttctacacaagtacactgtgcagccgagtgccatccaccgaaagaccatatagtcaattacccggcgtcacacaccaccctcggggtccaagacatttccgctacggcgatgtcatgggtgcagaagatcacgggaggtgtgggactggttgtcgctgttgcagcactgatcctaatcgtggtgctatgcgtgtcgtttagcaggcacatgagtattaaggaccacttcaatgtctataaagccacaagaccgtacctagctcactgtcccgactgtggagaagggcactcgtgccatagtcccgtagcgctagaacgcatcagaaacgaagcgacagacgggacgttgaaaatccaggtttccttgcaaatcggaataaagacggatgatagccatgattggaccaagctgcgttatatggacaatcacatgccagcagacgcagagcgggccgggctatttgtaagaacgtcagcaccgtgcacgattactggaacaatgggacacttcattctggcccgatgtccgaaaggagaaactctgacggtggggttcactgacggtaggaagatcagtcactcatgtacgcacccatttcaccatgaccctcctgtgataggccgggaaaaattccattcccgaccgcagcacggtagggaactaccttgcagcacgtacgcgcagagcaccgctgcaactgccgaggagatagaggtacacatgcccccagacaccccagatcgcacattaatgtcacaacagtccggcaatgtaaagatcacagtcaatagtcagacggtgcggtacaagtgcaattgtggtgactcaagtgaaggattaaccactacagataaagtgattaataactgcaaggtcgatcaatgccatgccgcggtcaccaatcacaaaaaatggcagtataactcccctctggtcccgcgtaatgctgaattcggggaccggaaaggaaaagttcacattccatttcctctggcaaatgtgacatgcagggtgcctaaagcaagaaaccccaccgtgacgtacggaaaaaaccaagtcatcatgttgctgtatcctgaccacccaacgctcctgtcctacaggaatatgggagaagaaccaaactatcaagaagagtgggtgacgcataagaaggagatcaggttaaccgtgccgactgaggggctcgaggtcacgtggggtaacaatgagccgtacaagtattggccgcagttatccacaaacggtacagcccacggccacccgcatgagataattctgtattattatgagctgtacccaactatgactgcggtagttttgtcagtggcctcgttcatactcctgtcgatggtgggtgtggcagtggggatgtgcatgtgtgcacgacgcagatgcattacaccgtacgaactgacaccaggagctaccgtccctttcctgcttagcctaatatgctgcattagaacagctaaagcgtacgaacacgtaacagtgatcccgaacacggtgggagtaccgtataagactctagtcaacagaccgggctacagccccatggtattggagatggagcttctgtctgtcaccttggaaccaacgctatcgcttgattacatcacgtgcgagtataaaaccgttatcccgtctccgtacgtgaaatgctgcggtacagcagagtgtaaggacaagagcctacctgattacagctgtaaggtcttcaccggcgtctacccattcatgtggggcggcgcctactgcttctgcgacaccgaaaatacgcaattgagcgaagcacatgtggagaagtccgaatcatgcaaaacagaatttgcatcagcatacagggctcataccgcatccgcatcagctaagctccgcgtcctttaccaaggaaataatatcactgtggctgcttatgcaaacggcgaccatgccgtcacagttaaggacgctaaattcatagtggggccaatgtcttcagcctggacacctttcgacaataaaatcgtggtgtacaaaggcgacgtctacaacatggactacccgcccttcggcgcaggaagaccaggacaatttggcgacatccaaagtcgcacgcctgagagcgaagacgtctatgctaatacacaactggtactgcagagaccgtccgcgggtacggtgcacgtgccgtactctcaggcaccatctggcttcaagtattggctaaaagaacgaggggcgtcgctgcagcacacagcaccatttggctgtcaaatagcaacaaacccggtaagagcgatgaactgcgccgtagggaacatgcctatctccatcgacataccggacgcggcctttaccagggtcgtcgacgcgccatctttaacggacatgtcgtgtgaggtatcagcctgcacccattcctcagactttgggggcgtagccatcattaaatatgcagccagtaagaaaggcaagtgtgcagtgcactcgatgactaacgccgtcactattcgggaagctgaaatagaagtagaagggaactctcagttgcaaatctctttttcgacggccctagccagcgccgaatttcgcgtacaagtctgttctacacaagtacactgtgcagccgagtgccatccaccgaaagaccatatagtcaattacccggcgtcacacaccaccctcggggtccaagacatttccgctacggcgatgtcatgggtgcagaagatcacgggaggtgtgggactggttgtcgctgttgcagcactgatcctaatcgtggtgctatgcgtgtcgtttagcaggcactgataataggctggagcctcggtggccatgcttcttgccccttgggcctccccccagcccctcctccccttcctgcacccgtacccccgtggtctttgaataaagtctgagtgggcggc

SEQ ID NO: 386 - DNA, 2902 bp, Chikungunya Virus
tcaagcttttggaccctcgtacagaagctaatacgactcactatagggaaataagagagaaaagaagagtaagaagaaatataagagccaccatgccatatctagctcattgtcctgactgcggagaagggcattcgtgccacagccctatcgcattggagcgcatcagaaatgaagcaacggacggaacgctgaaaatccaggtctctttgcagatcgggataaagacagatgacagccacgattggaccaagctgcgctatatggatagccatacgccagcggacgcggagcgagccggattgcttgtaaggacttcagcaccgtgcacgatcaccgggaccatgggacactttattctcgcccgatgcccgaaaggagagacgctgacagtgggatttacggacagcagaaagatcagccacacatgcacacacccgttccatcatgaaccacctgtgataggtagggagaggttccactctcgaccacaacatggtaaagagttaccttgcagcacgtacgtgcagagcaccgctgccactgctgaggagatagaggtgcatatgcccccagatactcctgaccgcacgctgatgacgcagcagtctggcaacgtgaagatcacagttaatgggcagacggtgcggtacaagtgcaactgcggtggctcaaacgagggactgacaaccacagacaaagtgatcaataactgcaaaattgatcagtgccatgctgcagtcactaatcacaagaattggcaatacaactcccctttagtcccgcgcaacgctgaactcggggaccgtaaaggaaagatccacatcccattcccattggcaaacgtgacttgcagagtgccaaaagcaagaaaccctacagtaacttacggaaaaaaccaagtcaccatgctgctgtatcctgaccatccgacactcttgtcttaccgtaacatgggacaggaaccaaattaccacgaggagtgggtgacacacaagaaggaggttaccttgaccgtgcctactgagggtctggaggtcacttggggcaacaacgaaccatacaagtactggccgcagatgtctacgaacggtactgctcatggtcacccacatgagataatcttgtactattatgagctgtaccccactatgactgtagtcattgtgtcggtggcctcgttcgtgcttctgtcgatggtgggcacagcagtgggaatgtgtgtgtgcgcacggcgcagatgcattacaccatatgaattaacaccaggagccactgttcccttcctgctcagcctgctatgctgcctatggaacgaacagcagcccctgttctggttgcaggctcttatcccgctggccgccttgatcgtcctgtgcaactgtctgaaactcttgccatgctgctgtaagaccctggcttttttagccgtaatgagcatcggtgcccacactgtgagcgcgtacgaacacgtaacagtgatcccgaacacggtgggagtaccgtataagactcttgtcaacagaccgggttacagccccatggtgttggagatggagctacaatcagtcaccttggaaccaacactgtcacttgactacatcacgtgcgagtacaaaactgtcatcccctccccgtacgtgaagtgctgtggtacagcagagtgcaaggacaagagcctaccagactacagctgcaaggtctttactggagtctacccatttatgtggggcggcgcctactgcttttgcgacgccgaaaatacgcaattgagcgaggcacatgtagagaaatctgaatcttgcaaaacagagtttgcatcggcctacagagcccacaccgcatcggcgtcggcgaagctccgcgtcctttaccaaggaaacaacattaccgtagctgcctacgctaacggtgaccatgccgtcacagtaaaggacgccaagtttgtcgtgggcccaatgtcctccgcctggacaccttttgacaacaaaatcgtggtgtacaaaggcgacgtctacaacatggactacccaccttttggcgcaggaagaccaggacaatttggtgacattcaaagtcgtacaccggaaagtaaagacgtttatgccaacactcagttggtactacagaggccagcagcaggcacggtacatgtaccatactctcaggcaccatctggcttcaagtattggctgaaggaacgaggagcatcgctacagcacacggcaccgttcggttgccagattgcgacaaacccggtaagagctgtaaattgcgctgtggggaacataccaatttccatcgacataccggatgcggcctttactagggttgtcgatgcaccctctgtaacggacatgtcatgcgaagtaccagcctgcactcactcctccgactttgggggcgtcgccatcatcaaatacacagctagcaagaaaggtaaatgtgcagtacattcgatgaccaacgccgttaccattcgagaagccgacgtagaagtagaggggaactcccagctgcaaatatccttctcaacagccctggcaagcgccgagtttcgcgtgcaagtgtgctccacacaagtacactgcgcagccgcatgccaccctccaaaggaccacatagtcaattacccagcatcacacaccacccttggggtccaggatatatccacaacggcaatgtcttgggtgcagaagattacgggaggagtaggattaattgttgctgttgctgccttaattttaattgtggtgctatgcgtgtcgtttagcaggcactaatgataataggctggagcctcggtggccatgcttcttgccccttgggcctccccccagcccctcctccccttcctgcacccgtacccccgtggtctttgaataaagtctgagtgggcggc

SEQ ID NO: 387 - DNA, 3979 bp, Chikungunya Virus
tcaagcttttggaccctcgtacagaagctaatacgactcactatagggaaataagagagaaaagaagagtaagaagaaatataagagccaccatggagtttatccctacgcagacgttctataatcggaggtaccagcccaggccttgggccccccgccctacaatccaagtgataagaccacgtcccaggccgcagagacaagccggccaattggcgcaactcatcagcgcagttaacaagttgaccatgcgagcggttcctcagcagaagccgaggcggaaccggaagaataagaaacaacgccaaaagaaacaggcgccgcagaacgaccctaaacagaagaaacaacctccccagaaaaagccagctcagaagaagaagaagcctggacgccgtgaaagaatgtgcatgaaaatcgaaaatgattgcatctttgaggtgaagcacgagggcaaagtgatggggtacgcatgcctggtgggcgataaggtcatgaagccagcacatgtgaaggggacaatcgataatgctgatctggccaagctagcttttaaacgtagctccaaatacgatcttgagtgtgcccagatacctgtgcacatgaaatctgatgcaagcaagttcacacacgagaagcctgagggctattataactggcatcatggtgcggttcagtactccggcggccgatttaccattcctacaggggcaggaaagccgggcgattcggggagacccattttcgacaacaaaggccgcgtggtagctatcgtgctcggtggggctaatgagggtgcacgtactgcacttagcgtggttacctggaataaggacattgtcacaaagattacaccggagggagcagaggaatggagcctggcactgcccgttctgtgcctgctggccaacaccactttcccatgtagtcaacccccttgcactccctgctgctatgagaaagagcctgagagcacgttacgtatgctggaagataatgtcatgaggcccgggtactatcaactgctcaaggctagtctgacatgctcgccccacaggcagcgcaggtccacgaaagataacttcaacgtttacaaggctactaggccttatttggcccactgtcccgattgcggagagggacattcttgtcatagtcctattgccttggagcgaatccgcaacgaggccactgatggaacccttaagattcaagtatctttgcagattggcattaagacagatgattcccatgactggacaaagcttcggtacatggactcacacacgcctgcagatgctgaaagggcagggctcttggtcaggacctcggccccttgtacaattaccgggaccatgggccacttcatccttgcacgctgccctaagggggagacgctgacggtgggctttactgactcgcgtaagatctcacacacatgtacacaccctttccaccacgaacctccagtcatagggagagagagatttcactctcgcccacagcatggcaaagagctgccatgctccacatatgtccagagcactgctgctaccgctgaagaaattgaggttcacatgccacccgatacaccagaccgtactctgatgacccaacagagcggcaacgtgaagattaccgtaaatggacagaccgtgagatataagtgcaactgtggtggctccaatgagggcttaacaacaacggataaggtgattaacaattgcaaaatagatcagtgccatgccgcagtgaccaatcacaagaattggcaatacaactcacccctagtgccgaggaacgcagaactaggcgacaggaaagggaaaatccatatacccttccccctagcaaatgtgacctgccgagtgcccaaggccagaaaccccacggttacttacggcaagaaccaggtgacgatgcttttgtacccagaccatcccaccttgctctcttatagaaacatgggacaggagcctaactatcatgaggagtgggtgacacacaagaaagaagtcacccttaccgtgcctaccgaagggcttgaagtcacctggggcaacaacgagccttacaagtattggccacagatgtccacaaacggaacagcccacggccacccgcacgagatcatactgtattactatgagctttatcccacaatgactgtcgtaattgtgagcgttgccagcttcgtgttgctttcaatggttggcactgccgtggggatgtgcgtgtgtgctaggcgccgctgtataactccttatgaactaactccaggcgccaccgttcctttcctgctctcactactgtgttgtgtgcgcacaacaaaggctgccacctactacgaagccgccgcctacttatggaatgaacagcagcctctcttttggttacaggcgctgattcctcttgctgccctgatcgtgctatgcaactgcctcaagctgctgccctgttgttgcaagaccctagcttttctcgccgtgatgagcatcggggcacatacagtgtccgcctatgagcacgtcaccgttatcccgaacaccgtcggtgtgccatataagacgttagtcaatcgacccggctactctccaatggtgctggaaatggaactccagagtgtgacactggagccaaccttatccctcgattatattacctgcgaatacaagaccgtcatcccttcaccctatgtcaagtgctgtgggaccgctgaatgcaaagacaagagcttgcctgattacagttgcaaggtcttcacaggtgtgtaccccttcatgtgggggggagcttattgcttttgtgatgctgagaacacccaactgagcgaggctcacgtcgagaaatctgagtcttgcaagaccgagtttgcctcagcttacagggcccacacggccagcgcatccgccaaattgagggtactctaccagggtaataatatcaccgttgccgcatatgcaaacggcgatcacgccgtgactgtcaaggatgccaagttcgttgtgggccccatgtctagcgcttggacaccgttcgataataagatcgtcgtgtacaaaggggacgtgtataatatggactacccacctttcggggccggccgaccgggacagttcggggatattcagagccgcacacccgaatctaaagatgtttacgccaatactcagctcgtcctgcagaggcccgccgctggtacagttcacgttccttactcacaggcaccctctgggtttaagtattggctgaaagaacgaggtgccagcttgcagcatacagcgcctttcggatgccagattgccactaaccccgtacgggctgtcaactgcgcggtcggcaatattcccattagcattgatatcccggacgcagctttcaccagggttgtggacgccccgagcgtcaccgacatgagttgtgaggtgccagcctgcacgcatagcagtgatttcggcggcgtcgccatcattaaatataccgcaagcaagaaaggcaagtgcgccgtccactcgatgactaacgccgtcacaattcgggaagccgatgttgaggtcgaaggcaactcccagctgcagatcagcttctctactgctcttgcaagcgccgagtttcgagtccaggtctgcagtacgcaggtgcattgtgcagctgcctgccatccacccaaagatcatattgtgaattatccggcgtcacataccacactgggggtccaggatattagtacaacggcgatgtcctgggtgcagaaaattacgggaggagtgggcttaattgttgccgtggcggccctgatcctgatcgttgtgctgtgtgttagcttctctaggcatgactataaagatgacgatgacaaatgataataggctggagcctcggtggccatgcttcttgccccttgggcctccccccagcccctcctccccttcctgcacccgtacccccgtggtctttgaataaagtctgagtgggcggc

SEQ ID NO: 388 - DNA, 3955 bp, Chikungunya Virus
tcaagcttttggaccctcgtacagaagctaatacgactcactatagggaaataagagagaaaagaagagtaagaagaaatataagagccaccatggagtttatccctacgcagacgttctataatcggaggtaccagcccaggccttgggccccccgccctacaatccaagtgataagaccacgtcccaggccgcagagacaagccggccaattggcgcaactcatcagcgcagttaacaagttgaccatgcgagcggttcctcagcagaagccgaggcggaaccggaagaataagaaacaacgccaaaagaaacaggcgccgcagaacgaccctaaacagaagaaacaacctccccagaaaaagccagctcagaagaagaagaagcctggacgccgtgaaagaatgtgcatgaaaatcgaaaatgattgcatctttgaggtgaagcacgagggcaaagtgatggggtacgcatgcctggtgggcgataaggtcatgaagccagcacatgtgaaggggacaatcgataatgctgatctggccaagctagcttttaaacgtagctccaaatacgatcttgagtgtgcccagatacctgtgcacatgaaatctgatgcaagcaagttcacacacgagaagcctgagggctattataactggcatcatggtgcggttcagtactccggcggccgatttaccattcctacaggggcaggaaagccgggcgattcggggagacccattttcgacaacaaaggccgcgtggtagctatcgtgctcggtggggctaatgagggtgcacgtactgcacttagcgtggttacctggaataaggacattgtcacaaagattacaccggagggagcagaggaatggagcctggcactgcccgttctgtgcctgctggccaacaccactttcccatgtagtcaacccccttgcactccctgctgctatgagaaagagcctgagagcacgttacgtatgctggaagataatgtcatgaggcccgggtactatcaactgctcaaggctagtctgacatgctcgccccacaggcagcgcaggtccacgaaagataacttcaacgtttacaaggctactaggccttatttggcccactgtcccgattgcggagagggacattcttgtcatagtcctattgccttggagcgaatccgcaacgaggccactgatggaacccttaagattcaagtatctttgcagattggcattaagacagatgattcccatgactggacaaagcttcggtacatggactcacacacgcctgcagatgctgaaagggcagggctcttggtcaggacctcggccccttgtacaattaccgggaccatgggccacttcatccttgcacgctgccctaagggggagacgctgacggtgggctttactgactcgcgtaagatctcacacacatgtacacaccctttccaccacgaacctccagtcatagggagagagagatttcactctcgcccacagcatggcaaagagctgccatgctccacatatgtccagagcactgctgctaccgctgaagaaattgaggttcacatgccacccgatacaccagaccgtactctgatgacccaacagagcggcaacgtgaagattaccgtaaatggacagaccgtgagatataagtgcaactgtggtggctccaatgagggcttaacaacaacggataaggtgattaacaattgcaaaatagatcagtgccatgccgcagtgaccaatcacaagaattggcaatacaactcacccctagtgccgaggaacgcagaactaggcgacaggaaagggaaaatccatatacccttccccctagcaaatgtgacctgccgagtgcccaaggccagaaaccccacggttacttacggcaagaaccaggtgacgatgcttttgtacccagaccatcccaccttgctctcttatagaaacatgggacaggagcctaactatcatgaggagtgggtgacacacaagaaagaagtcacccttaccgtgcctaccgaagggcttgaagtcacctggggcaacaacgagccttacaagtattggccacagatgtccacaaacggaacagcccacggccacccgcacgagatcatactgtattactatgagctttatcccacaatgactgtcgtaattgtgagcgttgccagcttcgtgttgctttcaatggttggcactgccgtggggatgtgcgtgtgtgctaggcgccgctgtataactccttatgaactaactccaggcgccaccgttcctttcctgctctcactactgtgttgtgtgcgcacaacaaaggctgccacctactacgaagccgccgcctacttatggaatgaacagcagcctctcttttggttacaggcgctgattcctcttgctgccctgatcgtgctatgcaactgcctcaagctgctgccctgttgttgcaagaccctagcttttctcgccgtgatgagcatcggggcacatacagtgtccgcctatgagcacgtcaccgttatcccgaacaccgtcggtgtgccatataagacgttagtcaatcgacccggctactctccaatggtgctggaaatggaactccagagtgtgacactggagccaaccttatccctcgattatattacctgcgaatacaagaccgtcatcccttcaccctatgtcaagtgctgtgggaccgctgaatgcaaagacaagagcttgcctgattacagttgcaaggtcttcacaggtgtgtaccccttcatgtgggggggagcttattgcttttgtgatgctgagaacacccaactgagcgaggctcacgtcgagaaatctgagtcttgcaagaccgagtttgcctcagcttacagggcccacacggccagcgcatccgccaaattgagggtactctaccagggtaataatatcaccgttgccgcatatgcaaacggcgatcacgccgtgactgtcaaggatgccaagttcgttgtgggccccatgtctagcgcttggacaccgttcgataataagatcgtcgtgtacaaaggggacgtgtataatatggactacccacctttcggggccggccgaccgggacagttcggggatattcagagccgcacacccgaatctaaagatgtttacgccaatactcagctcgtcctgcagaggcccgccgctggtacagttcacgttccttactcacaggcaccctctgggtttaagtattggctgaaagaacgaggtgccagcttgcagcatacagcgcctttcggatgccagattgccactaaccccgtacgggctgtcaactgcgcggtcggcaatattcccattagcattgatatcccggacgcagctttcaccagggttgtggacgccccgagcgtcaccgacatgagttgtgaggtgccagcctgcacgcatagcagtgatttcggcggcgtcgccatcattaaatataccgcaagcaagaaaggcaagtgcgccgtccactcgatgactaacgccgtcacaattcgggaagccgatgttgaggtcgaaggcaactcccagctgcagatcagcttctctactgctcttgcaagcgccgagtttcgagtccaggtctgcagtacgcaggtgcattgtgcagctgcctgccatccacccaaagatcatattgtgaattatccggcgtcacataccacactgggggtccaggatattagtacaacggcgatgtcctgggtgcagaaaattacgggaggagtgggcttaattgttgccgtggcggccctgatcctgatcgttgtgctgtgtgttagcttctctaggcattgataataggctggagcctcggtggccatgcttcttgccccttgggcctccccccagcccctcctccccttcctgcacccgtacccccgtggtctttgaataaagtctgagtgggcggc

SEQ ID NO: 389 - RNA, 1537 nt, Chikungunya Virus
ucaagcuuuuggacccucguacagaagcuaauacgacucacuauagggaaauaagagagaaaagaagaguaagaagaaauauaagagccaccauggagacaccugcacagcuguuguuucugcugcugcuuugguugcccgauaccaccggugacuacaaagacgacgacgauaaauacgagcacgugacgguaauaccaaacacugugggggugccauacaagacccugguaaaucgcccaggcuacucucccauggugcuggagauggagcuccagucugugaccuuagagccaacccucucacucgacuauaucaccugugaauacaaaacagugaucccaucccccuacgugaaauguugcggaacugcagaguguaaggauaagagucugcccgauuacagcugcaagguguuuacaggcguguauccauuuauguggggaggagccuacuguuuuugcgaugccgaaaauacucagcugucugaagcccauguggagaagagugaaaguugcaagaccgaauuugcuagugccuacagggcacacaccgcuucugccuccgcuaaacuccgaguccuuuaccagggcaauaauauuacggucgcugccuacgcuaacggggaccacgcugugacagucaaggacgccaaauucguagugggcccaaugagcuccgccuggacucccuucgacaacaaaaucgucguguauaaaggcgacguguacaauauggacuacccacccuucggggcuggaagaccgggccaguuuggagauauccaaucaaggacacccgagucaaaggacguguacgccaauacgcagcuggugcugcagagacccgccgcugguaccgugcaugugccuuauucccaagcuccaucuggcuucaaguacugguugaaagagcgcggugcuucgcugcagcauacagcaccguucggaugucagauagcaaccaacccuguacgggcugucaacugugccgugggaaauauaccuauuuccaucgacauuccggacgcagcuuucacacgugucguugaugcccccucagugacugacaugucaugugaggugccugcuugcacccacagcagcgauuuuggcggaguggccauaaucaaguacaccgccuccaaaaaaggaaagugugccguacacucuaugaccaacgccgucacaaucagagaagccgacguugaaguagagggaaauucacagcugcaaaucagcuucagcaccgcucuugccucugcugaguuuaggguucagguuugcaguacucaggugcacugugcagccgcuugccauccccccaaggaucauaucgugaauuauccugcaucccacaccacacugggaguccaggauaucucaacaacugcaaugucuugggugcagaagaucaccugauaauaggcuggagccucgguggccaugcuucuugccccuugggccuccccccagccccuccuccccuuccugcacccguacccccguggucuuugaauaaagucugagugggcggc

SEQ ID NO: 390 - RNA, 1531 nt, Chikungunya Virus
ucaagcuuuuggacccucguacagaagcuaauacgacucacuauagggaaauaagagagaaaagaagaguaagaagaaauauaagagccaccauguacgaacacguaacagugaucccgaacacggugggaguaccguauaagacucuagucaacagaccgggcuacagccccaugguauuggagauggagcuucugucugucaccuuggaaccaacgcuaucgcuugauuacaucacgugcgaguauaaaaccguuaucccgucuccguacgugaaaugcugcgguacagcagaguguaaggacaagagccuaccugauuacagcuguaaggucuucaccggcgucuacccauucauguggggcggcgccuacugcuucugcgacaccgaaaauacgcaauugagcgaagcacauguggagaaguccgaaucaugcaaaacagaauuugcaucagcauacagggcucauaccgcauccgcaucagcuaagcuccgcguccuuuaccaaggaaauaauaucacuguggcugcuuaugcaaacggcgaccaugccgucacaguuaaggacgcuaaauucauaguggggccaaugucuucagccuggacaccuuucgacaauaaaaucgugguguacaaaggcgacgucuacaacauggacuacccgcccuucggcgcaggaagaccaggacaauuuggcgacauccaaagucgcacgccugagagcgaagacgucuaugcuaauacacaacugguacugcagagaccguccgcggguacggugcacgugccguacucucaggcaccaucuggcuucaaguauuggcuaaaagaacgaggggcgucgcugcagcacacagcaccauuuggcugucaaauagcaacaaacccgguaagagcgaugaacugcgccguagggaacaugccuaucuccaucgacauaccggacgcggccuuuaccagggucgucgacgcgccaucuuuaacggacaugucgugugagguaucagccugcacccauuccucagacuuugggggcguagccaucauuaaauaugcagccaguaagaaaggcaagugugcagugcacucgaugacuaacgccgucacuauucgggaagcugaaauagaaguagaagggaacucucaguugcaaaucucuuuuucgacggcccuagccagcgccgaauuucgcguacaagucuguucuacacaaguacacugugcagccgagugccauccaccgaaagaccauauagucaauuacccggcgucacacaccacccucgggguccaagacauuuccgcuacggcgaugucaugggugcagaagaucacgggaggugugggacugguugucgcuguugcagcacugauccuaaucguggugcuaugcgugucguuuagcaggcacugauaauaggcuggagccucgguggccaugcuucuugccccuugggccuccccccagccccuccuccccuuccugcacccguacccccguggucuuugaauaaagucugagugggcggc

SEQ ID NO: 391 - RNA, 1690 nt, Chikungunya Virus
ucaagcuuuuggacccucguacagaagcuaauacgacucacuauagggaaauaagagagaaaagaagaguaagaagaaauauaagagccaccaugcuauggaacgaacagcagccccuguucugguugcaggcucuuaucccgcuggccgccuugaucguccugugcaacugucugaaacucuugccaugcugcuguaagacccuggcuuuuuuagccguaaugagcaucggugcccacacugugagcgcguacgaacacguaacagugaucccgaacacggugggaguaccguauaagacucuugucaacagaccggguuacagccccaugguguuggagauggagcuacaaucagucaccuuggaaccaacacugucacuugacuacaucacgugcgaguacaaaacugucauccccuccccguacgugaagugcugugguacagcagagugcaaggacaagagccuaccagacuacagcugcaaggucuuuacuggagucuacccauuuauguggggcggcgccuacugcuuuugcgacgccgaaaauacgcaauugagcgaggcacauguagagaaaucugaaucuugcaaaacagaguuugcaucggccuacagagcccacaccgcaucggcgucggcgaagcuccgcguccuuuaccaaggaaacaacauuaccguagcugccuacgcuaacggugaccaugccgucacaguaaaggacgccaaguuugucgugggcccaauguccuccgccuggacaccuuuugacaacaaaaucgugguguacaaaggcgacgucuacaacauggacuacccaccuuuuggcgcaggaagaccaggacaauuuggugacauucaaagucguacaccggaaaguaaagacguuuaugccaacacucaguugguacuacagaggccagcagcaggcacgguacauguaccauacucucaggcaccaucuggcuucaaguauuggcugaaggaacgaggagcaucgcuacagcacacggcaccguucgguugccagauugcgacaaacccgguaagagcuguaaauugcgcuguggggaacauaccaauuuccaucgacauaccggaugcggccuuuacuaggguugucgaugcacccucuguaacggacaugucaugcgaaguaccagccugcacucacuccuccgacuuugggggcgucgccaucaucaaauacacagcuagcaagaaagguaaaugugcaguacauucgaugaccaacgccguuaccauucgagaagccgacguagaaguagaggggaacucccagcugcaaauauccuucucaacagcccuggcaagcgccgaguuucgcgugcaagugugcuccacacaaguacacugcgcagccgcaugccacccuccaaaggaccacauagucaauuacccagcaucacacaccacccuugggguccaggauauauccacaacggcaaugucuugggugcagaagauuacgggaggaguaggauuaauuguugcuguugcugccuuaauuuuaauuguggugcuaugcgugucguuuagcaggcacuaaugauaauaggcuggagccucgguggccaugcuucuugccccuugggccuccccccagccccuccuccccuuccugcacccguacccccguggucuuugaauaaagucugagugggcggc

SEQ ID NO: 392 - RNA, 1531 nt, Chikungunya Virus
ucaagcuuuuggacccucguacagaagcuaauacgacucacuauagggaaauaagagagaaaagaagaguaagaagaaauauaagagccaccauguacgaacacguaacagugaucccgaacacggugggaguaccguauaagacucuagucaauagaccgggcuacagucccaugguauuggagauggaacuacugucagucacuuuggagccaacgcuaucgcuugauuacaucacgugcgaguacaaaaccguuaucccgucuccguacgugaaaugcugcgguacagcagagugcaaggacaaaaaccuaccugacuacagcuguaaggucuucaccggcgucuacccauuuauguggggcggagccuacugcuucugcgacgcugaaaacacgcaauugagcgaagcacacguggagaaguccgaaucaugcaaaacagaauuugcaucagcauacagggcucauaccgcauccgcaucagcuaagcuccgcguccuuuaccaaggaaauaacaucacuguaacugccuaugcuaacggcgaccaugccgucacaguuaaggacgccaaauucauuguggggccaaugucuucagccuggacaccuuucgacaacaaaauugugguguacaaaggugacgucuauaacauggacuacccgcccuuuggcgcaggaagaccaggacaauuuggcgauauccaaagucgcacaccugagaguaaagacgucuaugcuaauacacaacugguacugcagagaccggcugcggguacgguacaugugccauacucucaggcaccaucuggcuuuaaguauuggcuaaaagaacgaggggcgucgcugcagcacacagcaccauuuggcugccaaauagcaacaaacccgguaagagcggugaauugcgccguagggaacaugcccaucuccaucgacauaccggaugcggccuucauuagggucgucgacgcgcccucuuuaacggacaugucgugcgagguaccagccugcacccauuccucagauuucgggggcgucgccauuauuaaauaugcagccagcaagaaaggcaagugugcggugcauucgaugaccaacgccgucacaauucgggaagcugagauagaaguugaagggaauucucagcugcaaaucucuuucucgacggccuuggccagcgccgaauuccgcguacaagucuguucuacacaaguacacuguguagccgagugccacccuccgaaggaccacauagucaauuacccggcgucacauaccacccucgggguccaggacauuuccgcuacggcgcugucaugggugcagaagaucacgggaggcgugggacugguugucgcuguugcagcacugauucuaaucguggugcuaugcgugucguucagcaggcacugauaauaggcuggagccucgguggccaugcuucuugccccuugggccuccccccagccccuccuccccuuccugcacccguacccccguggucuuugaauaaagucugagugggcggc

SEQ ID NO: 393 - RNA, 1340 nt, Chikungunya Virus
auggagaccccagcucagcuucuguuucuucuccuucuauggcugccugacacgacuggacaucaccaccaucaucauaguacaaaagacaauuucaauguguacaaggccacccgcccuuauuuagcacacuguccagauugcggugaggggcacuccugucacucuccuaucgccuuggagcggauccggaaugaggcgaccgauggaacacugaaaauccagguaagcuugcagauuggcaucaagacugacgauagccaugauuggaccaaacuacgguauauggauagccauacaccugccgaugcugaacgggccggucugcuugugagaacuagcgcuccaugcaccaucacggggacaaugggacauuuuauccuggcuagaugcccaaagggcgaaacccucaccgucggauucaccgacucaaggaaaauuucucacacauguacccaucccuuccaccaugagccaccggugaucgggcgcgaacgcuuccacagcaggccucagcauggaaaagaacugccaugcucgaccuauguacaguccaccgccgcuaccgccgaagagaucgaagugcauaugccucccgacacacccgaccgaacccuaaugacacaacaaucugggaaugugaagauuacagucaauggacagacugugagguauaaguguaacugcgguggcucaaaugagggccucaccacaacggauaaggugaucaauaacugcaaaauugaccagugucacgcggccgugaccaaccauaagaacuggcaguacaacucacccuuagugccuaggaacgcugagcugggagaucgcaaggggaagauacacauucccuucccguuggcgaaugugaccugccgugugccaaaagcgagaaauccuaccguaacauauggcaaaaaucaggugaccauguugcucuacccggaucacccaacucugcugagcuaucggaauaugggacaagaacccaauuaccacgaggaauggguuacgcacaagaaagaggugacccuuacagucccuacugaaggucuggaagugaccuggggcaauaacgagccuuauaaguacuggccccagaugaguacaaacggcaccgcccauggacauccacacgagaucauucuguauuacuacgaacuauaucccacaaugacuggcaagccuauaccaaacccacuucucggccuugauagcacaugauaauaggcuggagccucgguggccaugcuucuugccccuugggccuccccccagccccuccuccccuuccugcacccguacccccguggucuuugaauaaagucugagugggcggc

SEQ ID NO: 394 - RNA, 1483 nt, Chikungunya Virus
ucaagcuuuuggacccucguacagaagcuaauacgacucacuauagggaaauaagagagaaaagaagaguaagaagaaauauaagagccaccaugaguaccaaggacaacuucaaugucuauaaagccacaagaccguacuuagcucacugucccgacuguggagaagggcacucgugccauagucccguagcauuagaacgcaucagaaaugaagcgacagacgggacgcugaaaauccaggucuccuugcaaaucggaauaaagacggaugauagccacgauuggaccaagcugcguuacauggacaaccacacgccagcggacgcagagagggcggggcuauuuguaagaacaucagcaccgugcacgauuacuggaacaaugggacacuucauccugacccgauguccgaaaggggaaacucugacggugggauucacugacaguaggaagaucagucacucauguacgcacccauuucaccacgacccuccugugauaggccgggagaaauuccauucccgaccgcagcacgguaaagagcugccuugcagcacguacgugcagagcaccgccgcaacuaccgaggagauagagguacacaugcccccagacaccccugaucgcacauugaugucacaacaguccggcaacguaaagaucacaguuaauggccagacggugcgguacaaguguaauugcgguggcucaaaugaaggacuaauaacuacagacaaagugauuaauaacugcaaaguugaucaaugucaugccgcggucaccaaucacaaaaaguggcaguacaacuccccucuggucccgcguaaugcugaacuuggggaccgaaaaggaaaaauccacaucccguuuccgcuggcaaauguaacaugcagggugccuaaagcaaggaaccccaccgugacguacgggaaaaaccaagucaucaugcuacuguaucccgaccacccaacacuccuguccuaccggaacaugggagaagaaccaaacuaccaagaagagugggugacgcauaagaaggaagucgugcuaaccgugccgacugaagggcucgaggucacgugggguaacaacgagccguauaaguauuggccgcaguuaucuacaaacgguacagcccauggccacccgcaugagauaauucuguauuauuaugagcuguacccuacuaugacuguaguaguugugucaguggccucguucguacuccugucgaugguggguguggcaguggggaugugcaugugugcacgacgcagaugcaucacaccguacgaacugacaccaggagcuaccgucccuuuccugcuuagccuaauaugcugcaucagaacagcuaaagcgugauaauaggcuggagccucgguggccaugcuucuugccccuugggccuccccccagccccuccuccccuuccugcacccguacccccguggucuuugaauaaagucugagugggcggc

SEQ ID NO: 395 - RNA, 1483 nt, Chikungunya Virus
ucaagcuuuuggacccucguacagaagcuaauacgacucacuauagggaaauaagagagaaaagaagaguaagaagaaauauaagagccaccaugaguauuaaggaccacuucaaugucuauaaagccacaagaccguaccuagcucacugucccgacuguggagaagggcacucgugccauagucccguagcgcuagaacgcaucagaaacgaagcgacagacgggacguugaaaauccagguuuccuugcaaaucggaauaaagacggaugauagccaugauuggaccaagcugcguuauauggacaaucacaugccagcagacgcagagcgggccgggcuauuuguaagaacgucagcaccgugcacgauuacuggaacaaugggacacuucauucuggcccgauguccgaaaggagaaacucugacggugggguucacugacgguaggaagaucagucacucauguacgcacccauuucaccaugacccuccugugauaggccgggaaaaauuccauucccgaccgcagcacgguagggaacuaccuugcagcacguacgcgcagagcaccgcugcaacugccgaggagauagagguacacaugcccccagacaccccagaucgcacauuaaugucacaacaguccggcaauguaaagaucacagucaauagucagacggugcgguacaagugcaauuguggugacucaagugaaggauuaaccacuacagauaaagugauuaauaacugcaaggucgaucaaugccaugccgcggucaccaaucacaaaaaauggcaguauaacuccccucuggucccgcguaaugcugaauucggggaccggaaaggaaaaguucacauuccauuuccucuggcaaaugugacaugcagggugccuaaagcaagaaaccccaccgugacguacggaaaaaaccaagucaucauguugcuguauccugaccacccaacgcuccuguccuacaggaauaugggagaagaaccaaacuaucaagaagagugggugacgcauaagaaggagaucagguuaaccgugccgacugaggggcucgaggucacgugggguaacaaugagccguacaaguauuggccgcaguuauccacaaacgguacagcccacggccacccgcaugagauaauucuguauuauuaugagcuguacccaacuaugacugcgguaguuuugucaguggccucguucauacuccugucgaugguggguguggcaguggggaugugcaugugugcacgacgcagaugcauuacaccguacgaacugacaccaggagcuaccgucccuuuccugcuuagccuaauaugcugcauuagaacagcuaaagcgugauaauaggcuggagccucgguggccaugcuucuugccccuugggccuccccccagccccuccuccccuuccugcacccguacccccguggucuuugaauaaagucugagugggcggc

SEQ ID NO: 396 - RNA, 1426 nt, Chikungunya Virus
ucaagcuuuuggacccucguacagaagcuaauacgacucacuauagggaaauaagagagaaaagaagaguaagaagaaauauaagagccaccaugccauaucuagcucauuguccugacugcggagaagggcauucgugccacagcccuaucgcauuggagcgcaucagaaaugaagcaacggacggaacgcugaaaauccaggucucuuugcagaucgggauaaagacagaugacagccacgauuggaccaagcugcgcuauauggauagccauacgccagcggacgcggagcgagccggauugcuuguaaggacuucagcaccgugcacgaucaccgggaccaugggacacuuuauucucgcccgaugcccgaaaggagagacgcugacagugggauuuacggacagcagaaagaucagccacacaugcacacacccguuccaucaugaaccaccugugauagguagggagagguuccacucucgaccacaacaugguaaagaguuaccuugcagcacguacgugcagagcaccgcugccacugcugaggagauagaggugcauaugcccccagauacuccugaccgcacgcugaugacgcagcagucuggcaacgugaagaucacaguuaaugggcagacggugcgguacaagugcaacugcgguggcucaaacgagggacugacaaccacagacaaagugaucaauaacugcaaaauugaucagugccaugcugcagucacuaaucacaagaauuggcaauacaacuccccuuuagucccgcgcaacgcugaacucggggaccguaaaggaaagauccacaucccauucccauuggcaaacgugacuugcagagugccaaaagcaagaaacccuacaguaacuuacggaaaaaaccaagucaccaugcugcuguauccugaccauccgacacucuugucuuaccguaacaugggacaggaaccaaauuaccacgaggagugggugacacacaagaaggagguuaccuugaccgugccuacugagggucuggaggucacuuggggcaacaacgaaccauacaaguacuggccgcagaugucuacgaacgguacugcucauggucacccacaugagauaaucuuguacuauuaugagcuguaccccacuaugacuguagucauugugucgguggccucguucgugcuucugucgauggugggcacagcagugggaaugugugugugcgcacggcgcagaugcauuacaccauaugaauuaacaccaggagccacuguucccuuccugcucagccugcuaugcugcugauaauaggcuggagccucgguggccaugcuucuugccccuugggccuccccccagccccuccuccccuuccugcacccguacccccguggucuuugaauaaagucugagugggcggc

SEQ ID NO: 397 - RNA, 2800 nt, Chikungunya Virus
ucaagcuuuuggacccucguacagaagcuaauacgacucacuauagggaaauaagagagaaaagaagaguaagaagaaauauaagagccaccaugaguaccaaggacaacuucaaugucuauaaagccacaagaccguacuuagcucacugucccgacuguggagaagggcacucgugccauagucccguagcauuagaacgcaucagaaaugaagcgacagacgggacgcugaaaauccaggucuccuugcaaaucggaauaaagacggaugauagccacgauuggaccaagcugcguuacauggacaaccacacgccagcggacgcagagagggcggggcuauuuguaagaacaucagcaccgugcacgauuacuggaacaaugggacacuucauccugacccgauguccgaaaggggaaacucugacggugggauucacugacaguaggaagaucagucacucauguacgcacccauuucaccacgacccuccugugauaggccgggagaaauuccauucccgaccgcagcacgguaaagagcugccuugcagcacguacgugcagagcaccgccgcaacuaccgaggagauagagguacacaugcccccagacaccccugaucgcacauugaugucacaacaguccggcaacguaaagaucacaguuaauggccagacggugcgguacaaguguaauugcgguggcucaaaugaaggacuaauaacuacagacaaagugauuaauaacugcaaaguugaucaaugucaugccgcggucaccaaucacaaaaaguggcaguacaacuccccucuggucccgcguaaugcugaacuuggggaccgaaaaggaaaaauccacaucccguuuccgcuggcaaauguaacaugcagggugccuaaagcaaggaaccccaccgugacguacgggaaaaaccaagucaucaugcuacuguaucccgaccacccaacacuccuguccuaccggaacaugggagaagaaccaaacuaccaagaagagugggugacgcauaagaaggaagucgugcuaaccgugccgacugaagggcucgaggucacgugggguaacaacgagccguauaaguauuggccgcaguuaucuacaaacgguacagcccauggccacccgcaugagauaauucuguauuauuaugagcuguacccuacuaugacuguaguaguugugucaguggccucguucguacuccugucgaugguggguguggcaguggggaugugcaugugugcacgacgcagaugcaucacaccguacgaacugacaccaggagcuaccgucccuuuccugcuuagccuaauaugcugcaucagaacagcuaaagcguacgaacacguaacagugaucccgaacacggugggaguaccguauaagacucuagucaauagaccgggcuacagucccaugguauuggagauggaacuacugucagucacuuuggagccaacgcuaucgcuugauuacaucacgugcgaguacaaaaccguuaucccgucuccguacgugaaaugcugcgguacagcagagugcaaggacaaaaaccuaccugacuacagcuguaaggucuucaccggcgucuacccauuuauguggggcggagccuacugcuucugcgacgcugaaaacacgcaauugagcgaagcacacguggagaaguccgaaucaugcaaaacagaauuugcaucagcauacagggcucauaccgcauccgcaucagcuaagcuccgcguccuuuaccaaggaaauaacaucacuguaacugccuaugcuaacggcgaccaugccgucacaguuaaggacgccaaauucauuguggggccaaugucuucagccuggacaccuuucgacaacaaaauugugguguacaaaggugacgucuauaacauggacuacccgcccuuuggcgcaggaagaccaggacaauuuggcgauauccaaagucgcacaccugagaguaaagacgucuaugcuaauacacaacugguacugcagagaccggcugcggguacgguacaugugccauacucucaggcaccaucuggcuuuaaguauuggcuaaaagaacgaggggcgucgcugcagcacacagcaccauuuggcugccaaauagcaacaaacccgguaagagcggugaauugcgccguagggaacaugcccaucuccaucgacauaccggaugcggccuucauuagggucgucgacgcgcccucuuuaacggacaugucgugcgagguaccagccugcacccauuccucagauuucgggggcgucgccauuauuaaauaugcagccagcaagaaaggcaagugugcggugcauucgaugaccaacgccgucacaauucgggaagcugagauagaaguugaagggaauucucagcugcaaaucucuuucucgacggccuuggccagcgccgaauuccgcguacaagucuguucuacacaaguacacuguguagccgagugccacccuccgaaggaccacauagucaauuacccggcgucacauaccacccucgggguccaggacauuuccgcuacggcgcugucaugggugcagaagaucacgggaggcgugggacugguugucgcuguugcagcacugauucuaaucguggugcuaugcgugucguucagcaggcacugauaauaggcuggagccucgguggccaugcuucuugccccuugggccuccccccagccccuccuccccuuccugcacccguacccccguggucuuugaauaaagucugagugggcggc

SEQ ID NO: 398 - RNA, 5389 nt, Chikungunya Virus
ucaagcuuuuggacccucguacagaagcuaauacgacucacuauagggaaauaagagagaaaagaagaguaagaagaaauauaagagccaccaugaguauuaaggaccacuucaaugucuauaaagccacaagaccguaccuagcucacugucccgacuguggagaagggcacucgugccauagucccguagcgcuagaacgcaucagaaacgaagcgacagacgggacguugaaaauccagguuuccuugcaaaucggaauaaagacggaugauagccaugauuggaccaagcugcguuauauggacaaucacaugccagcagacgcagagcgggccgggcuauuuguaagaacgucagcaccgugcacgauuacuggaacaaugggacacuucauucuggcccgauguccgaaaggagaaacucugacggugggguucacugacgguaggaagaucagucacucauguacgcacccauuucaccaugacccuccugugauaggccgggaaaaauuccauucccgaccgcagcacgguagggaacuaccuugcagcacguacgcgcagagcaccgcugcaacugccgaggagauagagguacacaugcccccagacaccccagaucgcacauuaaugucacaacaguccggcaauguaaagaucacagucaauagucagacggugcgguacaagugcaauuguggugacucaagugaaggauuaaccacuacagauaaagugauuaauaacugcaaggucgaucaaugccaugccgcggucaccaaucacaaaaaauggcaguauaacuccccucuggucccgcguaaugcugaauucggggaccggaaaggaaaaguucacauuccauuuccucuggcaaaugugacaugcagggugccuaaagcaagaaaccccaccgugacguacggaaaaaaccaagucaucauguugcuguauccugaccacccaacgcuccuguccuacaggaauaugggagaagaaccaaacuaucaagaagagugggugacgcauaagaaggagaucagguuaaccgugccgacugaggggcucgaggucacgugggguaacaaugagccguacaaguauuggccgcaguuauccacaaacgguacagcccacggccacccgcaugagauaauucuguauuauuaugagcuguacccaacuaugacugcgguaguuuugucaguggccucguucauacuccugucgaugguggguguggcaguggggaugugcaugugugcacgacgcagaugcauuacaccguacgaacugacaccaggagcuaccgucccuuuccugcuuagccuaauaugcugcauuagaacagcuaaagcguacgaacacguaacagugaucccgaacacggugggaguaccguauaagacucuagucaacagaccgggcuacagccccaugguauuggagauggagcuucugucugucaccuuggaaccaacgcuaucgcuugauuacaucacgugcgaguauaaaaccguuaucccgucuccguacgugaaaugcugcgguacagcagaguguaaggacaagagccuaccugauuacagcuguaaggucuucaccggcgucuacccauucauguggggcggcgccuacugcuucugcgacaccgaaaauacgcaauugagcgaagcacauguggagaaguccgaaucaugcaaaacagaauuugcaucagcauacagggcucauaccgcauccgcaucagcuaagcuccgcguccuuuaccaaggaaauaauaucacuguggcugcuuaugcaaacggcgaccaugccgucacaguuaaggacgcuaaauucauaguggggccaaugucuucagccuggacaccuuucgacaauaaaaucgugguguacaaaggcgacgucuacaacauggacuacccgcccuucggcgcaggaagaccaggacaauuuggcgacauccaaagucgcacgccugagagcgaagacgucuaugcuaauacacaacugguacugcagagaccguccgcggguacggugcacgugccguacucucaggcaccaucuggcuucaaguauuggcuaaaagaacgaggggcgucgcugcagcacacagcaccauuuggcugucaaauagcaacaaacccgguaagagcgaugaacugcgccguagggaacaugccuaucuccaucgacauaccggacgcggccuuuaccagggucgucgacgcgccaucuuuaacggacaugucgugugagguaucagccugcacccauuccucagacuuugggggcguagccaucauuaaauaugcagccaguaagaaaggcaagugugcagugcacucgaugacuaacgccgucacuauucgggaagcugaaauagaaguagaagggaacucucaguugcaaaucucuuuuucgacggcccuagccagcgccgaauuucgcguacaagucuguucuacacaaguacacugugcagccgagugccauccaccgaaagaccauauagucaauuacccggcgucacacaccacccucgggguccaagacauuuccgcuacggcgaugucaugggugcagaagaucacgggaggugugggacugguugucgcuguugcagcacugauccuaaucguggugcuaugcgugucguuuagcaggcacaugaguauuaaggaccacuucaaugucuauaaagccacaagaccguaccuagcucacugucccgacuguggagaagggcacucgugccauagucccguagcgcuagaacgcaucagaaacgaagcgacagacgggacguugaaaauccagguuuccuugcaaaucggaauaaagacggaugauagccaugauuggaccaagcugcguuauauggacaaucacaugccagcagacgcagagcgggccgggcuauuuguaagaacgucagcaccgugcacgauuacuggaacaaugggacacuucauucuggcccgauguccgaaaggagaaacucugacggugggguucacugacgguaggaagaucagucacucauguacgcacccauuucaccaugacccuccugugauaggccgggaaaaauuccauucccgaccgcagcacgguagggaacuaccuugcagcacguacgcgcagagcaccgcugcaacugccgaggagauagagguacacaugcccccagacaccccagaucgcacauuaaugucacaacaguccggcaauguaaagaucacagucaauagucagacggugcgguacaagugcaauuguggugacucaagugaaggauuaaccacuacagauaaagugauuaauaacugcaaggucgaucaaugccaugccgcggucaccaaucacaaaaaauggcaguauaacuccccucuggucccgcguaaugcugaauucggggaccggaaaggaaaaguucacauuccauuuccucuggcaaaugugacaugcagggugccuaaagcaagaaaccccaccgugacguacggaaaaaaccaagucaucauguugcuguauccugaccacccaacgcuccuguccuacaggaauaugggagaagaaccaaacuaucaagaagagugggugacgcauaagaaggagaucagguuaaccgugccgacugaggggcucgaggucacgugggguaacaaugagccguacaaguauuggccgcaguuauccacaaacgguacagcccacggccacccgcaugagauaauucuguauuauuaugagcuguacccaacuaugacugcgguaguuuugucaguggccucguucauacuccugucgaugguggguguggcaguggggaugugcaugugugcacgacgcagaugcauuacaccguacgaacugacaccaggagcuaccgucccuuuccugcuuagccuaauaugcugcauuagaacagcuaaagcguacgaacacguaacagugaucccgaacacggugggaguaccguauaagacucuagucaacagaccgggcuacagccccaugguauuggagauggagcuucugucugucaccuuggaaccaacgcuaucgcuugauuacaucacgugcgaguauaaaaccguuaucccgucuccguacgugaaaugcugcgguacagcagaguguaaggacaagagccuaccugauuacagcuguaaggucuucaccggcgucuacccauucauguggggcggcgccuacugcuucugcgacaccgaaaauacgcaauugagcgaagcacauguggagaaguccgaaucaugcaaaacagaauuugcaucagcauacagggcucauaccgcauccgcaucagcuaagcuccgcguccuuuaccaaggaaauaauaucacuguggcugcuuaugcaaacggcgaccaugccgucacaguuaaggacgcuaaauucauaguggggccaaugucuucagccuggacaccuuucgacaauaaaaucgugguguacaaaggcgacgucuacaacauggacuacccgcccuucggcgcaggaagaccaggacaauuuggcgacauccaaagucgcacgccugagagcgaagacgucuaugcuaauacacaacugguacugcagagaccguccgcggguacggugcacgugccguacucucaggcaccaucuggcuucaaguauuggcuaaaagaacgaggggcgucgcugcagcacacagcaccauuuggcugucaaauagcaacaaacccgguaagagcgaugaacugcgccguagggaacaugccuaucuccaucgacauaccggacgcggccuuuaccagggucgucgacgcgccaucuuuaacggacaugucgugugagguaucagccugcacccauuccucagacuuugggggcguagccaucauuaaauaugcagccaguaagaaaggcaagugugcagugcacucgaugacuaacgccgucacuauucgggaagcugaaauagaaguagaagggaacucucaguugcaaaucucuuuuucgacggcccuagccagcgccgaauuucgcguacaagucuguucuacacaaguacacugugcagccgagugccauccaccgaaagaccauauagucaauuacccggcgucacacaccacccucgggguccaagacauuuccgcuacggcgaugucaugggugcagaagaucacgggaggugugggacugguugucgcuguugcagcacugauccuaaucguggugcuaugcgugucguuuagcaggcacugauaauaggcuggagccucgguggccaugcuucuugccccuugggccuccccccagccccuccuccccuuccugcacccguacccccguggucuuugaauaaagucugagugggcggc

SEQ ID NO: 399 - RNA, 2902 nt, Chikungunya Virus
ucaagcuuuuggacccucguacagaagcuaauacgacucacuauagggaaauaagagagaaaagaagaguaagaagaaauauaagagccaccaugccauaucuagcucauuguccugacugcggagaagggcauucgugccacagcccuaucgcauuggagcgcaucagaaaugaagcaacggacggaacgcugaaaauccaggucucuuugcagaucgggauaaagacagaugacagccacgauuggaccaagcugcgcuauauggauagccauacgccagcggacgcggagcgagccggauugcuuguaaggacuucagcaccgugcacgaucaccgggaccaugggacacuuuauucucgcccgaugcccgaaaggagagacgcugacagugggauuuacggacagcagaaagaucagccacacaugcacacacccguuccaucaugaaccaccugugauagguagggagagguuccacucucgaccacaacaugguaaagaguuaccuugcagcacguacgugcagagcaccgcugccacugcugaggagauagaggugcauaugcccccagauacuccugaccgcacgcugaugacgcagcagucuggcaacgugaagaucacaguuaaugggcagacggugcgguacaagugcaacugcgguggcucaaacgagggacugacaaccacagacaaagugaucaauaacugcaaaauugaucagugccaugcugcagucacuaaucacaagaauuggcaauacaacuccccuuuagucccgcgcaacgcugaacucggggaccguaaaggaaagauccacaucccauucccauuggcaaacgugacuugcagagugccaaaagcaagaaacccuacaguaacuuacggaaaaaaccaagucaccaugcugcuguauccugaccauccgacacucuugucuuaccguaacaugggacaggaaccaaauuaccacgaggagugggugacacacaagaaggagguuaccuugaccgugccuacugagggucuggaggucacuuggggcaacaacgaaccauacaaguacuggccgcagaugucuacgaacgguacugcucauggucacccacaugagauaaucuuguacuauuaugagcuguaccccacuaugacuguagucauugugucgguggccucguucgugcuucugucgauggugggcacagcagugggaaugugugugugcgcacggcgcagaugcauuacaccauaugaauuaacaccaggagccacuguucccuuccugcucagccugcuaugcugccuauggaacgaacagcagccccuguucugguugcaggcucuuaucccgcuggccgccuugaucguccugugcaacugucugaaacucuugccaugcugcuguaagacccuggcuuuuuuagccguaaugagcaucggugcccacacugugagcgcguacgaacacguaacagugaucccgaacacggugggaguaccguauaagacucuugucaacagaccggguuacagccccaugguguuggagauggagcuacaaucagucaccuuggaaccaacacugucacuugacuacaucacgugcgaguacaaaacugucauccccuccccguacgugaagugcugugguacagcagagugcaaggacaagagccuaccagacuacagcugcaaggucuuuacuggagucuacccauuuauguggggcggcgccuacugcuuuugcgacgccgaaaauacgcaauugagcgaggcacauguagagaaaucugaaucuugcaaaacagaguuugcaucggccuacagagcccacaccgcaucggcgucggcgaagcuccgcguccuuuaccaaggaaacaacauuaccguagcugccuacgcuaacggugaccaugccgucacaguaaaggacgccaaguuugucgugggcccaauguccuccgccuggacaccuuuugacaacaaaaucgugguguacaaaggcgacgucuacaacauggacuacccaccuuuuggcgcaggaagaccaggacaauuuggugacauucaaagucguacaccggaaaguaaagacguuuaugccaacacucaguugguacuacagaggccagcagcaggcacgguacauguaccauacucucaggcaccaucuggcuucaaguauuggcugaaggaacgaggagcaucgcuacagcacacggcaccguucgguugccagauugcgacaaacccgguaagagcuguaaauugcgcuguggggaacauaccaauuuccaucgacauaccggaugcggccuuuacuaggguugucgaugcacccucuguaacggacaugucaugcgaaguaccagccugcacucacuccuccgacuuugggggcgucgccaucaucaaauacacagcuagcaagaaagguaaaugugcaguacauucgaugaccaacgccguuaccauucgagaagccgacguagaaguagaggggaacucccagcugcaaauauccuucucaacagcccuggcaagcgccgaguuucgcgugcaagugugcuccacacaaguacacugcgcagccgcaugccacccuccaaaggaccacauagucaauuacccagcaucacacaccacccuugggguccaggauauauccacaacggcaaugucuugggugcagaagauuacgggaggaguaggauuaauuguugcuguugcugccuuaauuuuaauuguggugcuaugcgugucguuuagcaggcacuaaugauaauaggcuggagccucgguggccaugcuucuugccccuugggccuccccccagccccuccuccccuuccugcacccguacccccguggucuuugaauaaagucugagugggcggc

SEQ ID NO: 400 - RNA, 3979 nt, Chikungunya Virus
ucaagcuuuuggacccucguacagaagcuaauacgacucacuauagggaaauaagagagaaaagaagaguaagaagaaauauaagagccaccauggaguuuaucccuacgcagacguucuauaaucggagguaccagcccaggccuugggccccccgcccuacaauccaagugauaagaccacgucccaggccgcagagacaagccggccaauuggcgcaacucaucagcgcaguuaacaaguugaccaugcgagcgguuccucagcagaagccgaggcggaaccggaagaauaagaaacaacgccaaaagaaacaggcgccgcagaacgacccuaaacagaagaaacaaccuccccagaaaaagccagcucagaagaagaagaagccuggacgccgugaaagaaugugcaugaaaaucgaaaaugauugcaucuuugaggugaagcacgagggcaaagugaugggguacgcaugccuggugggcgauaaggucaugaagccagcacaugugaaggggacaaucgauaaugcugaucuggccaagcuagcuuuuaaacguagcuccaaauacgaucuugagugugcccagauaccugugcacaugaaaucugaugcaagcaaguucacacacgagaagccugagggcuauuauaacuggcaucauggugcgguucaguacuccggcggccgauuuaccauuccuacaggggcaggaaagccgggcgauucggggagacccauuuucgacaacaaaggccgcgugguagcuaucgugcucgguggggcuaaugagggugcacguacugcacuuagcgugguuaccuggaauaaggacauugucacaaagauuacaccggagggagcagaggaauggagccuggcacugcccguucugugccugcuggccaacaccacuuucccauguagucaacccccuugcacucccugcugcuaugagaaagagccugagagcacguuacguaugcuggaagauaaugucaugaggcccggguacuaucaacugcucaaggcuagucugacaugcucgccccacaggcagcgcagguccacgaaagauaacuucaacguuuacaaggcuacuaggccuuauuuggcccacugucccgauugcggagagggacauucuugucauaguccuauugccuuggagcgaauccgcaacgaggccacugauggaacccuuaagauucaaguaucuuugcagauuggcauuaagacagaugauucccaugacuggacaaagcuucgguacauggacucacacacgccugcagaugcugaaagggcagggcucuuggucaggaccucggccccuuguacaauuaccgggaccaugggccacuucauccuugcacgcugcccuaagggggagacgcugacggugggcuuuacugacucgcguaagaucucacacacauguacacacccuuuccaccacgaaccuccagucauagggagagagagauuucacucucgcccacagcauggcaaagagcugccaugcuccacauauguccagagcacugcugcuaccgcugaagaaauugagguucacaugccacccgauacaccagaccguacucugaugacccaacagagcggcaacgugaagauuaccguaaauggacagaccgugagauauaagugcaacugugguggcuccaaugagggcuuaacaacaacggauaaggugauuaacaauugcaaaauagaucagugccaugccgcagugaccaaucacaagaauuggcaauacaacucaccccuagugccgaggaacgcagaacuaggcgacaggaaagggaaaauccauauacccuucccccuagcaaaugugaccugccgagugcccaaggccagaaaccccacgguuacuuacggcaagaaccaggugacgaugcuuuuguacccagaccaucccaccuugcucucuuauagaaacaugggacaggagccuaacuaucaugaggagugggugacacacaagaaagaagucacccuuaccgugccuaccgaagggcuugaagucaccuggggcaacaacgagccuuacaaguauuggccacagauguccacaaacggaacagcccacggccacccgcacgagaucauacuguauuacuaugagcuuuaucccacaaugacugucguaauugugagcguugccagcuucguguugcuuucaaugguuggcacugccguggggaugugcgugugugcuaggcgccgcuguauaacuccuuaugaacuaacuccaggcgccaccguuccuuuccugcucucacuacuguguugugugcgcacaacaaaggcugccaccuacuacgaagccgccgccuacuuauggaaugaacagcagccucucuuuugguuacaggcgcugauuccucuugcugcccugaucgugcuaugcaacugccucaagcugcugcccuguuguugcaagacccuagcuuuucucgccgugaugagcaucggggcacauacaguguccgccuaugagcacgucaccguuaucccgaacaccgucggugugccauauaagacguuagucaaucgacccggcuacucuccaauggugcuggaaauggaacuccagagugugacacuggagccaaccuuaucccucgauuauauuaccugcgaauacaagaccgucaucccuucacccuaugucaagugcugugggaccgcugaaugcaaagacaagagcuugccugauuacaguugcaaggucuucacagguguguaccccuucaugugggggggagcuuauugcuuuugugaugcugagaacacccaacugagcgaggcucacgucgagaaaucugagucuugcaagaccgaguuugccucagcuuacagggcccacacggccagcgcauccgccaaauugaggguacucuaccaggguaauaauaucaccguugccgcauaugcaaacggcgaucacgccgugacugucaaggaugccaaguucguugugggccccaugucuagcgcuuggacaccguucgauaauaagaucgucguguacaaaggggacguguauaauauggacuacccaccuuucggggccggccgaccgggacaguucggggauauucagagccgcacacccgaaucuaaagauguuuacgccaauacucagcucguccugcagaggcccgccgcugguacaguucacguuccuuacucacaggcacccucuggguuuaaguauuggcugaaagaacgaggugccagcuugcagcauacagcgccuuucggaugccagauugccacuaaccccguacgggcugucaacugcgcggucggcaauauucccauuagcauugauaucccggacgcagcuuucaccaggguuguggacgccccgagcgucaccgacaugaguugugaggugccagccugcacgcauagcagugauuucggcggcgucgccaucauuaaauauaccgcaagcaagaaaggcaagugcgccguccacucgaugacuaacgccgucacaauucgggaagccgauguugaggucgaaggcaacucccagcugcagaucagcuucucuacugcucuugcaagcgccgaguuucgaguccaggucugcaguacgcaggugcauugugcagcugccugccauccacccaaagaucauauugugaauuauccggcgucacauaccacacuggggguccaggauauuaguacaacggcgauguccugggugcagaaaauuacgggaggagugggcuuaauuguugccguggcggcccugauccugaucguugugcuguguguuagcuucucuaggcaugacuauaaagaugacgaugacaaaugauaauaggcuggagccucgguggccaugcuucuugccccuugggccuccccccagccccuccuccccuuccugcacccguacccccguggucuuugaauaaagucugagugggcggc

SEQ ID NO: 401 - RNA, 3955 nt, Chikungunya Virus
ucaagcuuuuggacccucguacagaagcuaauacgacucacuauagggaaauaagagagaaaagaagaguaagaagaaauauaagagccaccauggaguuuaucccuacgcagacguucuauaaucggagguaccagcccaggccuugggccccccgcccuacaauccaagugauaagaccacgucccaggccgcagagacaagccggccaauuggcgcaacucaucagcgcaguuaacaaguugaccaugcgagcgguuccucagcagaagccgaggcggaaccggaagaauaagaaacaacgccaaaagaaacaggcgccgcagaacgacccuaaacagaagaaacaaccuccccagaaaaagccagcucagaagaagaagaagccuggacgccgugaaagaaugugcaugaaaaucgaaaaugauugcaucuuugaggugaagcacgagggcaaagugaugggguacgcaugccuggugggcgauaaggucaugaagccagcacaugugaaggggacaaucgauaaugcugaucuggccaagcuagcuuuuaaacguagcuccaaauacgaucuugagugugcccagauaccugugcacaugaaaucugaugcaagcaaguucacacacgagaagccugagggcuauuauaacuggcaucauggugcgguucaguacuccggcggccgauuuaccauuccuacaggggcaggaaagccgggcgauucggggagacccauuuucgacaacaaaggccgcgugguagcuaucgugcucgguggggcuaaugagggugcacguacugcacuuagcgugguuaccuggaauaaggacauugucacaaagauuacaccggagggagcagaggaauggagccuggcacugcccguucugugccugcuggccaacaccacuuucccauguagucaacccccuugcacucccugcugcuaugagaaagagccugagagcacguuacguaugcuggaagauaaugucaugaggcccggguacuaucaacugcucaaggcuagucugacaugcucgccccacaggcagcgcagguccacgaaagauaacuucaacguuuacaaggcuacuaggccuuauuuggcccacugucccgauugcggagagggacauucuugucauaguccuauugccuuggagcgaauccgcaacgaggccacugauggaacccuuaagauucaaguaucuuugcagauuggcauuaagacagaugauucccaugacuggacaaagcuucgguacauggacucacacacgccugcagaugcugaaagggcagggcucuuggucaggaccucggccccuuguacaauuaccgggaccaugggccacuucauccuugcacgcugcccuaagggggagacgcugacggugggcuuuacugacucgcguaagaucucacacacauguacacacccuuuccaccacgaaccuccagucauagggagagagagauuucacucucgcccacagcauggcaaagagcugccaugcuccacauauguccagagcacugcugcuaccgcugaagaaauugagguucacaugccacccgauacaccagaccguacucugaugacccaacagagcggcaacgugaagauuaccguaaauggacagaccgugagauauaagugcaacugugguggcuccaaugagggcuuaacaacaacggauaaggugauuaacaauugcaaaauagaucagugccaugccgcagugaccaaucacaagaauuggcaauacaacucaccccuagugccgaggaacgcagaacuaggcgacaggaaagggaaaauccauauacccuucccccuagcaaaugugaccugccgagugcccaaggccagaaaccccacgguuacuuacggcaagaaccaggugacgaugcuuuuguacccagaccaucccaccuugcucucuuauagaaacaugggacaggagccuaacuaucaugaggagugggugacacacaagaaagaagucacccuuaccgugccuaccgaagggcuugaagucaccuggggcaacaacgagccuuacaaguauuggccacagauguccacaaacggaacagcccacggccacccgcacgagaucauacuguauuacuaugagcuuuaucccacaaugacugucguaauugugagcguugccagcuucguguugcuuucaaugguuggcacugccguggggaugugcgugugugcuaggcgccgcuguauaacuccuuaugaacuaacuccaggcgccaccguuccuuuccugcucucacuacuguguugugugcgcacaacaaaggcugccaccuacuacgaagccgccgccuacuuauggaaugaacagcagccucucuuuugguuacaggcgcugauuccucuugcugcccugaucgugcuaugcaacugccucaagcugcugcccuguuguugcaagacccuagcuuuucucgccgugaugagcaucggggcacauacaguguccgccuaugagcacgucaccguuaucccgaacaccgucggugugccauauaagacguuagucaaucgacccggcuacucuccaauggugcuggaaauggaacuccagagugugacacuggagccaaccuuaucccucgauuauauuaccugcgaauacaagaccgucaucccuucacccuaugucaagugcugugggaccgcugaaugcaaagacaagagcuugccugauuacaguugcaaggucuucacagguguguaccccuucaugugggggggagcuuauugcuuuugugaugcugagaacacccaacugagcgaggcucacgucgagaaaucugagucuugcaagaccgaguuugccucagcuuacagggcccacacggccagcgcauccgccaaauugaggguacucuaccaggguaauaauaucaccguugccgcauaugcaaacggcgaucacgccgugacugucaaggaugccaaguucguugugggccccaugucuagcgcuuggacaccguucgauaauaagaucgucguguacaaaggggacguguauaauauggacuacccaccuuucggggccggccgaccgggacaguucggggauauucagagccgcacacccgaaucuaaagauguuuacgccaauacucagcucguccugcagaggcccgccgcugguacaguucacguuccuuacucacaggcacccucuggguuuaaguauuggcugaaagaacgaggugccagcuugcagcauacagcgccuuucggaugccagauugccacuaaccccguacgggcugucaacugcgcggucggcaauauucccauuagcauugauaucccggacgcagcuuucaccaggguuguggacgccccgagcgucaccgacaugaguugugaggugccagccugcacgcauagcagugauuucggcggcgucgccaucauuaaauauaccgcaagcaagaaaggcaagugcgccguccacucgaugacuaacgccgucacaauucgggaagccgauguugaggucgaaggcaacucccagcugcagaucagcuucucuacugcucuugcaagcgccgaguuucgaguccaggucugcaguacgcaggugcauugugcagcugccugccauccacccaaagaucauauugugaauuauccggcgucacauaccacacuggggguccaggauauuaguacaacggcgauguccugggugcagaaaauuacgggaggagugggcuuaauuguugccguggcggcccugauccugaucguugugcuguguguuagcuucucuaggcauugauaauaggcuggagccucgguggccaugcuucuugccccuugggccuccccccagccccuccuccccuuccugcacccguacccccguggucuuugaauaaagucugagugggcggc

SEQ ID NO: 402 - protein, 440 aa, Chikungunya Virus
MYEHVTVIPNTVGVPYKTLVNRPGYSPMVLEMELLSVTLEPTLSLDYITCEYKTVIPSPYVKCCGTAECKDKSLPDYSCKVFTGVYPFMWGGAYCFCDTENTQLSEAHVEKSESCKTEFASAYRAHTASASAKLRVLYQGNNITVAAYANGDHAVTVKDAKFIVGPMSSAWTPFDNKIVVYKGDVYNMDYPPFGAGRPGQFGDIQSRTPESEDVYANTQLVLQRPSAGTVHVPYSQAPSGFKYWLKERGASLQHTAPFGCQIATNPVRAMNCAVGNMPISIDIPDAAFTRVVDAPSLTDMSCEVSACTHSSDFGGVAIIKYAASKKGKCAVHSMTNAVTIREAEIEVEGNSQLQISFSTALASAEFRVQVCSTQVHCAAECHPPKDHIVNYPASHTTLGVQDISATAMSWVQKITGGVGLVVAVAALILIVVLCVSFSRH

SEQ ID NO: 403 - protein, 440 aa, Chikungunya Virus
MYEHVTVIPNTVGVPYKTLVNRPGYSPMVLEMELLSVTLEPTLSLDYITCEYKTVIPSPYVKCCGTAECKDKNLPDYSCKVFTGVYPFMWGGAYCFCDAENTQLSEAHVEKSESCKTEFASAYRAHTASASAKLRVLYQGNNITVTAYANGDHAVTVKDAKFIVGPMSSAWTPFDNKIVVYKGDVYNMDYPPFGAGRPGQFGDIQSRTPESKDVYANTQLVLQRPAAGTVHVPYSQAPSGFKYWLKERGASLQHTAPFGCQIATNPVRAVNCAVGNMPISIDIPDAAFIRVVDAPSLTDMSCEVPACTHSSDFGGVAIIKYAASKKGKCAVHSMTNAVTIREAEIEVEGNSQLQISFSTALASAEFRVQVCSTQVHCVAECHPPKDHIVNYPASHTTLGVQDISATALSWVQKITGGVGLVVAVAALILIVVLCVSFSRH

SEQ ID NO: 404 - protein, 1726 aa, Chikungunya Virus
MSIKDHFNVYKATRPYLAHCPDCGEGHSCHSPVALERIRNEATDGTLKIQVSLQIGIKTDDSHDWTKLRYMDNHMPADAERAGLFVRTSAPCTITGTMGHFILARCPKGETLTVGFTDGRKISHSCTHPFHHDPPVIGREKFHSRPQHGRELPCSTYAQSTAATAEEIEVHMPPDTPDRTLMSQQSGNVKITVNSQTVRYKCNCGDSSEGLTTTDKVINNCKVDQCHAAVTNHKKWQYNSPLVPRNAEFGDRKGKVHIPFPLANVTCRVPKARNPTVTYGKNQVIMLLYPDHPTLLSYRNMGEEPNYQEEWVTHKKEIRLTVPTEGLEVTWGNNEPYKYWPQLSTNGTAHGHPHEIILYYYELYPTMTAVVLSVASFILLSMVGVAVGMCMCARRRCITPYELTPGATVPFLLSLICCIRTAKAYEHVTVIPNTVGVPYKTLVNRPGYSPMVLEMELLSVTLEPTLSLDYITCEYKTVIPSPYVKCCGTAECKDKSLPDYSCKVFTGVYPFMWGGAYCFCDTENTQLSEAHVEKSESCKTEFASAYRAHTASASAKLRVLYQGNNITVAAYANGDHAVTVKDAKFIVGPMSSAWTPFDNKIVVYKGDVYNMDYPPFGAGRPGQFGDIQSRTPESEDVYANTQLVLQRPSAGTVHVPYSQAPSGFKYWLKERGASLQHTAPFGCQIATNPVRAMNCAVGNMPISIDIPDAAFTRVVDAPSLTDMSCEVSACTHSSDFGGVAIIKYAASKKGKCAVHSMTNAVTIREAEIEVEGNSQLQISFSTALASAEFRVQVCSTQVHCAAECHPPKDHIVNYPASHTTLGVQDISATAMSWVQKITGGVGLVVAVAALILIVVLCVSFSRHMSIKDHFNVYKATRPYLAHCPDCGEGHSCHSPVALERIRNEATDGTLKIQVSLQIGIKTDDSHDWTKLRYMDNHMPADAERAGLFVRTSAPCTITGTMGHFILARCPKGETLTVGFTDGRKISHSCTHPFHHDPPVIGREKFHSRPQHGRELPCSTYAQSTAATAEEIEVHMPPDTPDRTLMSQQSGNVKITVNSQTVRYKCNCGDSSEGLTTTDKVINNCKVDQCHAAVTNHKKWQYNSPLVPRNAEFGDRKGKVHIPFPLANVTCRVPKARNPTVTYGKNQVIMLLYPDHPTLLSYRNMGEEPNYQEEWVTHKKEIRLTVPTEGLEVTWGNNEPYKYWPQLSTNGTAHGHPHEIILYYYELYPTMTAVVLSVASFILLSMVGVAVGMCMCARRRCITPYELTPGATVPFLLSLICCIRTAKAYEHVTVIPNTVGVPYKTLVNRPGYSPMVLEMELLSVTLEPTLSLDYITCEYKTVIPSPYVKCCGTAECKDKSLPDYSCKVFTGVYPFMWGGAYCFCDTENTQLSEAHVEKSESCKTEFASAYRAHTASASAKLRVLYQGNNITVAAYANGDHAVTVKDAKFIVGPMSSAWTPFDNKIVVYKGDVYNMDYPPFGAGRPGQFGDIQSRTPESEDVYANTQLVLQRPSAGTVHVPYSQAPSGFKYWLKERGASLQHTAPFGCQIATNPVRAMNCAVGNMPISIDIPDAAFTRVVDAPSLTDMSCEVSACTHSSDFGGVAIIKYAASKKGKCAVHSMTNAVTIREAEIEVEGNSQLQISFSTALASAEFRVQVCSTQVHCAAECHPPKDHIVNYPASHTTLGVQDISATAMSWVQKITGGVGLVVAVAALILIVVLCVSFSRH

SEQ ID NO: 405 - protein, 863 aa, Chikungunya Virus
MSTKDNFNVYKATRPYLAHCPDCGEGHSCHSPVALERIRNEATDGTLKIQVSLQIGIKTDDSHDWTKLRYMDNHTPADAERAGLFVRTSAPCTITGTMGHFILTRCPKGETLTVGFTDSRKISHSCTHPFHHDPPVIGREKFHSRPQHGKELPCSTYVQSTAATTEEIEVHMPPDTPDRTLMSQQSGNVKITVNGQTVRYKCNCGGSNEGLITTDKVINNCKVDQCHAAVTNHKKWQYNSPLVPRNAELGDRKGKIHIPFPLANVTCRVPKARNPTVTYGKNQVIMLLYPDHPTLLSYRNMGEEPNYQEEWVTHKKEVVLTVPTEGLEVTWGNNEPYKYWPQLSTNGTAHGHPHEIILYYYELYPTMTVVVVSVASFVLLSMVGVAVGMCMCARRRCITPYELTPGATVPFLLSLICCIRTAKAYEHVTVIPNTVGVPYKTLVNRPGYSPMVLEMELLSVTLEPTLSLDYITCEYKTVIPSPYVKCCGTAECKDKNLPDYSCKVFTGVYPFMWGGAYCFCDAENTQLSEAHVEKSESCKTEFASAYRAHTASASAKLRVLYQGNNITVTAYANGDHAVTVKDAKFIVGPMSSAWTPFDNKIVVYKGDVYNMDYPPFGAGRPGQFGDIQSRTPESKDVYANTQLVLQRPAAGTVHVPYSQAPSGFKYWLKERGASLQHTAPFGCQIATNPVRAVNCAVGNMPISIDIPDAAFIRVVDAPSLTDMSCEVPACTHSSDFGGVAIIKYAASKKGKCAVHSMTNAVTIREAEIEVEGNSQLQISFSTALASAEFRVQVCSTQVHCVAECHPPKDHIVNYPASHTTLGVQDISATALSWVQKITGGVGLVVAVAALILIVVLCVSFSRH

SEQ ID NO: 406 - protein, 424 aa, Chikungunya Virus
MSIKDHFNVYKATRPYLAHCPDCGEGHSCHSPVALERIRNEATDGTLKIQVSLQIGIKTDDSHDWTKLRYMDNHMPADAERAGLFVRTSAPCTITGTMGHFILARCPKGETLTVGFTDGRKISHSCTHPFHHDPPVIGREKFHSRPQHGRELPCSTYAQSTAATAEEIEVHMPPDTPDRTLMSQQSGNVKITVNSQTVRYKCNCGDSSEGLTTTDKVINNCKVDQCHAAVTNHKKWQYNSPLVPRNAEFGDRKGKVHIPFPLANVTCRVPKARNPTVTYGKNQVIMLLYPDHPTLLSYRNMGEEPNYQEEWVTHKKEIRLTVPTEGLEVTWGNNEPYKYWPQLSTNGTAHGHPHEIILYYYELYPTMTAVVLSVASFILLSMVGVAVGMCMCARRRCITPYELTPGATVPFLLSLICCIRTAKA

SEQ ID NO: 407 - protein, 424 aa, Chikungunya Virus
MSTKDNFNVYKATRPYLAHCPDCGEGHSCHSPVALERIRNEATDGTLKIQVSLQIGIKTDDSHDWTKLRYMDNHTPADAERAGLFVRTSAPCTITGTMGHFILTRCPKGETLTVGFTDSRKISHSCTHPFHHDPPVIGREKFHSRPQHGKELPCSTYVQSTAATTEEIEVHMPPDTPDRTLMSQQSGNVKITVNGQTVRYKCNCGGSNEGLITTDKVINNCKVDQCHAAVTNHKKWQYNSPLVPRNAELGDRKGKIHIPFPLANVTCRVPKARNPTVTYGKNQVIMLLYPDHPTLLSYRNMGEEPNYQEEWVTHKKEVVLTVPTEGLEVTWGNNEPYKYWPQLSTNGTAHGHPHEIILYYYELYPTMTVVVVSVASFVLLSMVGVAVGMCMCARRRCITPYELTPGATVPFLLSLICCIRTAKA

SEQ ID NO: 408 - protein, 1248 aa, Chikungunya Virus
MEFIPTQTFYNRRYQPRPWAPRPTIQVIRPRPRPQRQAGQLAQLISAVNKLTMRAVPQQKPRRNRKNKKQRQKKQAPQNDPKQKKQPPQKKPAQKKKKPGRRERMCMKIENDCIFEVKHEGKVMGYACLVGDKVMKPAHVKGTIDNADLAKLAFKRSSKYDLECAQIPVHMKSDASKFTHEKPEGYYNWHHGAVQYSGGRFTIPTGAGKPGDSGRPIFDNKGRVVAIVLGGANEGARTALSVVTWNKDIVTKITPEGAEEWSLALPVLCLLANTTFPCSQPPCTPCCYEKEPESTLRMLEDNVMRPGYYQLLKASLTCSPHRQRRSTKDNFNVYKATRPYLAHCPDCGEGHSCHSPIALERIRNEATDGTLKIQVSLQIGIKTDDSHDWTKLRYMDSHTPADAERAGLLVRTSAPCTITGTMGHFILARCPKGETLTVGFTDSRKISHTCTHPFHHEPPVIGRERFHSRPQHGKELPCSTYVQSTAATAEEIEVHMPPDTPDRTLMTQQSGNVKITVNGQTVRYKCNCGGSNEGLTTTDKVINNCKIDQCHAAVTNHKNWQYNSPLVPRNAELGDRKGKIHIPFPLANVTCRVPKARNPTVTYGKNQVTMLLYPDHPTLLSYRNMGQEPNYHEEWVTHKKEVTLTVPTEGLEVTWGNNEPYKYWPQMSTNGTAHGHPHEIILYYYELYPTMTVVIVSVASFVLLSMVGTAVGMCVCARRRCITPYELTPGATVPFLLSLLCCVRTTKAATYYEAAAYLWNEQQPLFWLQALIPLAALIVLCNCLKLLPCCCKTLAFLAVMSIGAHTVSAYEHVTVIPNTVGVPYKTLVNRPGYSPMVLEMELQSVTLEPTLSLDYITCEYKTVIPSPYVKCCGTAECKDKSLPDYSCKVFTGVYPFMWGGAYCFCDAENTQLSEAHVEKSESCKTEFASAYRAHTASASAKLRVLYQGNNITVAAYANGDHAVTVKDAKFVVGPMSSAWTPFDNKIVVYKGDVYNMDYPPFGAGRPGQFGDIQSRTPESKDVYANTQLVLQRPAAGTVHVPYSQAPSGFKYWLKERGASLQHTAPFGCQIATNPVRAVNCAVGNIPISIDIPDAAFTRVVDAPSVTDMSCEVPACTHSSDFGGVAIIKYTASKKGKCAVHSMTNAVTIREADVEVEGNSQLQISFSTALASAEFRVQVCSTQVHCAAACHPPKDHIVNYPASHTTLGVQDISTTAMSWVQKITGGVGLIVAVAALILIVVLCVSFSRH

SEQ ID NO: 409 - protein, 1248 aa, Chikungunya Virus; identical to SEQ ID NO: 408

SEQ ID NO: 410 - protein, 440 aa, Chikungunya Virus
MYEHVTVIPNTVGVPYKTLVNRPGYSPMVLEMELQSVTLEPTLSLDYITCEYKTVIPSPYVKCCGTAECKDKSLPDYSCKVFTGVYPFMWGGAYCFCDAENTQLSEAHVEKSESCKTEFASAYRAHTASASAKLRVLYQGNNITVAAYANGDHAVTVKDAKFVVGPMSSAWTPFDNKIVVYKGDVYNMDYPPFGAGRPGQFGDIQSRTPESKDVYANTQLVLQRPAAGTVHVPYSQAPSGFKYWLKERGASLQHTAPFGCQIATNPVRAVNCAVGNIPISIDIPDAAFTRVVDAPSVTDMSCEVPACTHSSDFGGVAIIKYTASKKGKCAVHSMTNAVTIREADVEVEGNSQLQISFSTALASAEFRVQVCSTQVHCAAACHPPKDHIVNYPASHTTLGVQDISTTAMSWVQKITGGVGLIVAVAALILIVVLCVSFSRH

SEQ ID NO: 411 - protein, 924 aa, Chikungunya Virus
MSTKDNFNVYKATRPYLAHCPDCGEGHSCHSPIALERIRNEATDGTLKIQVSLQIGIKTDDSHDWTKLRYMDSHTPADAERAGLLVRTSAPCTITGTMGHFILARCPKGETLTVGFTDSRKISHTCTHPFHHEPPVIGRERFHSRPQHGKELPCSTYVQSTAATAEEIEVHMPPDTPDRTLMTQQSGNVKITVNGQTVRYKCNCGGSNEGLTTTDKVINNCKIDQCHAAVTNHKNWQYNSPLVPRNAELGDRKGKIHIPFPLANVTCRVPKARNPTVTYGKNQVTMLLYPDHPTLLSYRNMGQEPNYHEEWVTHKKEVTLTVPTEGLEVTWGNNEPYKYWPQMSTNGTAHGHPHEIILYYYELYPTMTVVIVSVASFVLLSMVGTAVGMCVCARRRCITPYELTPGATVPFLLSLLCCVRTTKAATYYEAAAYLWNEQQPLFWLQALIPLAALIVLCNCLKLLPCCCKTLAFLAVMSIGAHTVSAYEHVTVIPNTVGVPYKTLVNRPGYSPMVLEMELQSVTLEPTLSLDYITCEYKTVIPSPYVKCCGTAECKDKSLPDYSCKVFTGVYPFMWGGAYCFCDAENTQLSEAHVEKSESCKTEFASAYRAHTASASAKLRVLYQGNNITVAAYANGDHAVTVKDAKFVVGPMSSAWTPFDNKIVVYKGDVYNMDYPPFGAGRPGQFGDIQSRTPESKDVYANTQLVLQRPAAGTVHVPYSQAPSGFKYWLKERGASLQHTAPFGCQIATNPVRAVNCAVGNIPISIDIPDAAFTRVVDAPSVTDMSCEVPACTHSSDFGGVAIIKYTASKKGKCAVHSMTNAVTIREADVEVEGNSQLQISFSTALASAEFRVQVCSTQVHCAAACHPPKDHIVNYPASHTTLGVQDISTTAMSWVQKITGGVGLIVAVAALILIVVLCVSFSRH

SEQ ID NO: 412 - protein, 424 aa, Chikungunya Virus
MSTKDNFNVYKATRPYLAHCPDCGEGHSCHSPIALERIRNEATDGTLKIQVSLQIGIKTDDSHDWTKLRYMDSHTPADAERAGLLVRTSAPCTITGTMGHFILARCPKGETLTVGFTDSRKISHTCTHPFHHEPPVIGRERFHSRPQHGKELPCSTYVQSTAATAEEIEVHMPPDTPDRTLMTQQSGNVKITVNGQTVRYKCNCGGSNEGLTTTDKVINNCKIDQCHAAVTNHKNWQYNSPLVPRNAELGDRKGKIHIPFPLANVTCRVPKARNPTVTYGKNQVTMLLYPDHPTLLSYRNMGQEPNYHEEWVTHKKEVTLTVPTEGLEVTWGNNEPYKYWPQMSTNGTAHGHPHEIILYYYELYPTMTVVIVSVASFVLLSMVGTAVGMCVCARRRCITPYELTPGATVPFLLSLLCCVRTTKA

SEQ ID NO: 413 - protein, 1262 aa, Chikungunya Virus
SSFWTLVQKLIRLTIGKERKEEEEIEPPWSLSLRRRSIIGGTSPGLGPPALQSKDHVPGRRDKPANWRNSSAQLTSPCERFLSRSRGGTGRIRNNAKRNRRRRTTLNRRNNLPRKSQLRRRRSLDAVKECAKSKMIASLRSTRAKWGTHAWWAIRSSQHMRGQSIMLIWPSLLNVAPNTILSVPRYLCTNLMQASSHTRSLRAIITGIMVRFSTPAADLPFLQGQESRAIRGDPFSTTKAAWLSCSVGLMRVHVLHLAWLPGIRTLSQRLHRREQRNGAWHCPFCACWPTPLSHVVNPLALPAAMRKSLRARYVCWKIMSGPGTINCSRLVHARPTGSAGPRKITSTFTRLLGLIWPTVPIAERDILVIVLLPWSESATRPLMEPLRFKYLCRLALRQMIPMTGQSFGTWTHTRLQMLKGQGSWSGPRPLVQLPGPWATSSLHAALRGRRRWALLTRVRSHTHVHTLSTTNLQSGERDFTLAHSMAKSCHAPHMSRALLLPLKKLRFTCHPIHQTVLPNRAATRLPMDRPDISATVVAPMRAQQRIRLTIAKISAMPQPITRIGNTTHPCRGTQNATGKGKSIYPSPQMPAECPRPETPRLLTARTRRCFCTQTIPPCSLIETWDRSLTIMRSGHTRKKSPLPCLPKGLKSPGATTSLTSIGHRCPQTEQPTATRTRSYCITMSFIPQLSLALPASCCFQWLALPWGCACVLGAAVLLMNLQAPPFLSCSHYCVVCAQQRLPPTTKPPPTYGMNSSLSFGYRRFLLLPSCYATASSCCPVVARPLFSPASGHIQCPPMSTSPLSRTPSVCHIRRSIDPATLQWCWKWNSRVHWSQPYPSIILPANTRPSSLHPMSSAVGPLNAKTRACLITVARSSQVCTPSCGGELIAFVMLRTPNARLTSRNLSLARPSLPQLTGPTRPAHPPNGYSTRVIISPLPHMQTAITPLSRMPSSLWAPCLALGHRSIIRSSCTKGTCIIWTTHLSGPADRDSSGIFRAAHPNLKMFTPILSSSCRGPPLVQFTFLTHRHPLGLSIGKNEVPACSIQRLSDARLPLTPYGLSTARSAIFPLALISRTQLSPGLWTPRASPTVVRCQPARIAVISAASPSLNIPQARKASAPSTRLTPSQFGKPMLRSKATPSCRSASLLLLQAPSFESRSAVRRCIVQLPAIHPKIILIIRRHIPHWGSRILVQRRCPGCRKLREEWALLPWRPSSLCCVLASLGIDNRLEPRWPCFLPLGPPPSPSSPSCTRTPVVFESLSGR

SEQ ID NO: 414 - protein, 9 aa, Artificial Sequence
  Synthetic Polynucleotide
HSMTNAVTI

SEQ ID NO: 415 - protein, 9 aa, Artificial Sequence
  Synthetic Polynucleotide
IILYYYELY

SEQ ID NO: 416 - protein, 9 aa, Artificial Sequence
  Synthetic Polynucleotide
ACLVGDKVM

SEQ ID NO: 417 - DNA, 1729 bp, Artificial Sequence
  Synthetic Polynucleotide
tcaagcttttggaccctcgtacagaagctaatacgactcactatagggaaataagagagaaaagaagagtaagaagaaatataagagccaccatggcacaagtcattaatacaaacagcctgtcgctgttgacccagaataacctgaacaaatcccagtccgcactgggcactgctatcgagcgtttgtcttccggtctgcgtatcaacagcgcgaaagacgatgcggcaggacaggcgattgctaaccgttttaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgcgaatggtactaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggtgccaacgacggtgaaactatcgatattgatttaaaagaaatcagctctaaaacactgggacttgataagcttaatgtccaagatgcctacaccccgaaagaaactgctgtaaccgttgataaaactacctataaaaatggtacagatcctattacagcccagagcaatactgatatccaaactgcaattggcggtggtgcaacgggggttactggggctgatatcaaatttaaagatggtcaatactatttagatgttaaaggcggtgcttctgctggtgtttataaagccacttatgatgaaactacaaagaaagttaatattgatacgactgataaaactccgttggcaactgcggaagctacagctattcggggaacggccactataacccacaaccaaattgctgaagtaacaaaagagggtgttgatacgaccacagttgcggctcaacttgctgcagcaggggttactggcgccgataaggacaatactagccttgtaaaactatcgtttgaggataaaaacggtaaggttattgatggtggctatgcagtgaaaatgggcgacgatttctatgccgctacatatgatgagaaaacaggtgcaattactgctaaaaccactacttatacagatggtactggcgttgctcaaactggagctgtgaaatttggtggcgcaaatggtaaatctgaagttgttactgctaccgatggtaagacttacttagcaagcgaccttgacaaacataacttcagaacaggcggtgagcttaaagaggttaatacagataagactgaaaacccactgcagaaaattgatgctgccttggcacaggttgatacacttcgttctgacctgggtgcggttcagaaccgtttcaactccgctatcaccaacctgggcaataccgtaaataacctgtcttctgcccgtagccgtatcgaagattccgactacgcaaccgaagtctccaacatgtctcgcgcgcagattctgcagcaggccggtacctccgttctggcgcaggcgaaccaggttccgcaaaacgtcctctctttactgcgttgataataggctggagcctcggtggccatgcttcttgccccttgggcctccccccagcccctcctccccttcctgcacccgtacccccgtggtctttgaataaagtctgagtgggcggc

SEQ ID NO: 418 - DNA, 1518 bp, Artificial Sequence
  Synthetic Polynucleotide
atggcacaagtcattaatacaaacagcctgtcgctgttgacccagaataacctgaacaaatcccagtccgcactgggcactgctatcgagcgtttgtcttccggtctgcgtatcaacagcgcgaaagacgatgcggcaggacaggcgattgctaaccgttttaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgcgaatggtactaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggtgccaacgacggtgaaactatcgatattgatttaaaagaaatcagctctaaaacactgggacttgataagcttaatgtccaagatgcctacaccccgaaagaaactgctgtaaccgttgataaaactacctataaaaatggtacagatcctattacagcccagagcaatactgatatccaaactgcaattggcggtggtgcaacgggggttactggggctgatatcaaatttaaagatggtcaatactatttagatgttaaaggcggtgcttctgctggtgtttataaagccacttatgatgaaactacaaagaaagttaatattgatacgactgataaaactccgttggcaactgcggaagctacagctattcggggaacggccactataacccacaaccaaattgctgaagtaacaaaagagggtgttgatacgaccacagttgcggctcaacttgctgcagcaggggttactggcgccgataaggacaatactagccttgtaaaactatcgtttgaggataaaaacggtaaggttattgatggtggctatgcagtgaaaatgggcgacgatttctatgccgctacatatgatgagaaaacaggtgcaattactgctaaaaccactacttatacagatggtactggcgttgctcaaactggagctgtgaaatttggtggcgcaaatggtaaatctgaagttgttactgctaccgatggtaagacttacttagcaagcgaccttgacaaacataacttcagaacaggcggtgagcttaaagaggttaatacagataagactgaaaacccactgcagaaaattgatgctgccttggcacaggttgatacacttcgttctgacctgggtgcggttcagaaccgtttcaactccgctatcaccaacctgggcaataccgtaaataacctgtcttctgcccgtagccgtatcgaagattccgactacgcaaccgaagtctccaacatgtctcgcgcgcagattctgcagcaggccggtacctccgttctggcgcaggcgaaccaggttccgcaaaacgtcctctctttactgcgt

SEQ ID NO: 419 - RNA, 1790 nt, Artificial Sequence
  Synthetic Polynucleotide
ggggaaauaagagagaaaagaagaguaagaagaaauauaagagccaccauggcacaagucauuaauacaaacagccugucgcuguugacccagaauaaccugaacaaaucccaguccgcacugggcacugcuaucgagcguuugucuuccggucugcguaucaacagcgcgaaagacgaugcggcaggacaggcgauugcuaaccguuuuaccgcgaacaucaaaggucugacucaggcuucccguaacgcuaacgacgguaucuccauugcgcagaccacugaaggcgcgcugaacgaaaucaacaacaaccugcagcgugugcgugaacuggcgguucagucugcgaaugguacuaacucccagucugaccucgacuccauccaggcugaaaucacccagcgccugaacgaaaucgaccguguauccggccagacucaguucaacggcgugaaaguccuggcgcaggacaacacccugaccauccagguuggugccaacgacggugaaacuaucgauauugauuuaaaagaaaucagcucuaaaacacugggacuugauaagcuuaauguccaagaugccuacaccccgaaagaaacugcuguaaccguugauaaaacuaccuauaaaaaugguacagauccuauuacagcccagagcaauacugauauccaaacugcaauuggcgguggugcaacggggguuacuggggcugauaucaaauuuaaagauggucaauacuauuuagauguuaaaggcggugcuucugcugguguuuauaaagccacuuaugaugaaacuacaaagaaaguuaauauugauacgacugauaaaacuccguuggcaacugcggaagcuacagcuauucggggaacggccacuauaacccacaaccaaauugcugaaguaacaaaagaggguguugauacgaccacaguugcggcucaacuugcugcagcagggguuacuggcgccgauaaggacaauacuagccuuguaaaacuaucguuugaggauaaaaacgguaagguuauugaugguggcuaugcagugaaaaugggcgacgauuucuaugccgcuacauaugaugagaaaacaggugcaauuacugcuaaaaccacuacuuauacagaugguacuggcguugcucaaacuggagcugugaaauuugguggcgcaaaugguaaaucugaaguuguuacugcuaccgaugguaagacuuacuuagcaagcgaccuugacaaacauaacuucagaacaggcggugagcuuaaagagguuaauacagauaagacugaaaacccacugcagaaaauugaugcugccuuggcacagguugauacacuucguucugaccugggugcgguucagaaccguuucaacuccgcuaucaccaaccugggcaauaccguaaauaaccugucuucugcccguagccguaucgaagauuccgacuacgcaaccgaagucuccaacaugucucgcgcgcagauucugcagcaggccgguaccuccguucuggcgcaggcgaaccagguuccgcaaaacguccucucuuuacugcguugauaauaggcuggagccucgguggccaugcuucuugccccuugggccuccccccagccccuccuccccuuccugcacccguacccccguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 420 - protein, 508 aa, Artificial Sequence
  Synthetic Polynucleotide
MAQVINTNSLSLLTQNNLNKSQSALGTAIERLSSGLRINSAKDDAAGQAIANRFTANIKGLTQASRNANDGISIAQTTEGALNEINNNLQRVRELAVQSANGTNSQSDLDSIQAEITQRLNEIDRVSGQTQFNGVKVLAQDNTLTIQVGANDGETIDIDLKEISSKTLGLDKLNVQDAYTPKETAVTVDKTTYKNGTDPITAQSNTDIQTAIGGGATGVTGADIKFKDGQYYLDVKGGASAGVYKATYDETTKKVNIDTTDKTPLATAEATAIRGTATITHNQIAEVTKEGVDTTTVAAQLAAAGVTGADKDNTSLVKLSFEDKNGKVIDGGYAVKMGDDFYAATYDEKTGAITAKTTTYTDGTGVAQTGAVKFGGANGKSEVVTATDGKTYLASDLDKHNFRTGGELKEVNTDKTENPLQKIDAALAQVDTLRSDLGAVQNRFNSAITNLGNTVNNLSSARSRIEDSDYATEVSNMSRAQILQQAGTSINVLAQANQVPQNVLSLLR

SEQ ID NO: 421 - protein, 708 aa, Artificial Sequence
  Synthetic Polynucleotide
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDTLNVQQKYKVSDTAATVTGYADTTIALDNSTFKASATGLGGTDQKIDGDLKFDDTTGKYYAKVTVTGGTGKDGYYEVSINVDKTNGEVTLAGGATSPLTGGLPATATEDVKNVQVANADLTEAKAALTAAGVTGTASINVVKMSYTDNNGKTIDGGLAVKVGDDYYSATQNKDGSISINTTKYTADDGTSKTALNKLGGADGKTEVVSIGGKTYAASKAEGHNFKAQPDLAEAAATTTENPLQKIDAALAQVDTLRSDLGAVQNRFNSAITNLGNTVNNLTSARSRIEDSDYATEVSNMSRAQILQQAGTSINVLAQANQVPQNVLSLLRGGGGSGGGGSMMAPDPNANPNANPNANPNANPNANPNANPNANPNANPNANPNANPNANPNANPNANPNANPNANPNANPNANPNANPNANPNKNNQGNGQGHNMPNDPNRNVDENANANNAVKNNNNEEPSDKHIEQYLKKIKNSISTEWSPCSINVTCGNGIQVRIKPGSANKPKDELDYENDIEKKICKMEKCSSINVFNVVNS

SEQ ID NO: 422 - protein, 702 aa, Artificial Sequence
  Synthetic Polynucleotide
MMAPDPNANPNANPNANPNANPNANPNANPNANPNANPNANPNANPNANPNANPNANPNANPNANPNANPNANPNANPNANPNKNNQGNGQGHNMPNDPNRNVDENANANNAVKNNNNEEPSDKHIEQYLKKIKNSISTEWSPCSINVTCGNGIQVRIKPGSANKPKDELDYENDIEKKICKMEKCSSINVFNVVNSRPVTMAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDTLNVQQKYKVSDTAATVTGYADTTIALDNSTFKASATGLGGTDQKIDGDLKFDDTTGKYYAKVTVTGGTGKDGYYEVSINVDKTNGEVTLAGGATSPLTGGLPATATEDVKNVQVANADLTEAKAALTAAGVTGTASINVVKMSYTDNNGKTIDGGLAVKVGDDYYSATQNKDGSISINTTKYTADDGTSKTALNKLGGADGKTEVVSIGGKTYAASKAEGHNFKAQPDLAEAAATTTENPLQKIDAALAQVDTLRSDLGAVQNRFNSAITNLGNTVNNLTSARSRIEDSDYATEVSNMSRAQILQQAGTSINVLAQANQVPQNVLSLLR

SEQ ID NO: 423 - protein, 20 aa, Artificial Sequence
  Synthetic Polynucleotide
METPAQLLFLLLLWLPDTTG

SEQ ID NO: 424 - protein, 18 aa, Artificial Sequence
  Synthetic Polynucleotide
MDWTWILFLVAAATRVHS

SEQ ID NO: 425 - protein, 24 aa, Artificial Sequence
  Synthetic Polynucleotide
MLGSNSGQRVVFTILLLLVAPAYS

SEQ ID NO: 426 - protein, 17 aa, Artificial Sequence
  Synthetic Polynucleotide
MKCLLYLAFLFIGVNCA

SEQ ID NO: 427 - protein, 15 aa, Artificial Sequence
  Synthetic Polynucleotide
MWLVSLAIVTACAGA

SEQ ID NO: 428 - protein, 13 aa, Salmonella typhimurium
LQRVRELAVQSAN

SEQ ID NO: 429 - protein, 4 aa, Artificial Sequence
  Synthetic Polynucleotide
GFLG

SEQ ID NO: 430 - protein, 4 aa, Artificial Sequence
  Synthetic Polynucleotide
KVSR

SEQ ID NO: 431 - protein, 5 aa, Artificial Sequence
  Synthetic Polynucleotide
TVGLR

SEQ ID NO: 432 - protein, 5 aa, Artificial Sequence
  Synthetic Polynucleotide
PMGLP

SEQ ID NO: 433 - protein, 5 aa, Artificial Sequence
  Synthetic Polynucleotide
PMGAP

SEQ ID NO: 434 - protein, 4 aa, Artificial Sequence
  Synthetic Polynucleotide
NANP

SEQ ID NO: 435 - protein, 4 aa, Artificial Sequence
  Synthetic Polynucleotide
NVDP

SEQ ID NO: 436 - protein, 9 aa, Artificial Sequence
  Synthetic Polynucleotide
TTDISEMGA

SEQ ID NO: 437 - protein, 9 aa, Artificial Sequence
  Synthetic Polynucleotide
TMWHVTRGA

SEQ ID NO: 438 - protein, 9 aa, Artificial Sequence
  Synthetic Polynucleotide
MWHVTRGAV

SEQ ID NO: 439 - protein, 9 aa, Artificial Sequence
  Synthetic Polynucleotide
GLYGNGVVT

SEQ ID NO: 440 - protein, 9 aa, Artificial Sequence
  Synthetic Polynucleotide
TLILAPTRV

SEQ ID NO: 441 - protein, 9 aa, Artificial Sequence
  Synthetic Polynucleotide
LILAPTRVV

SEQ ID NO: 442 - protein, 9 aa, Artificial Sequence
  Synthetic Polynucleotide
ILAPTRVVA

SEQ ID NO: 443 - protein, 9 aa, Artificial Sequence
  Synthetic Polynucleotide
VVAAEMEEA

SEQ ID NO: 444 - protein, 9 aa, Artificial Sequence
  Synthetic Polynucleotide
IVDLMCHAT

SEQ ID NO: 445 - protein, 9 aa, Artificial Sequence
  Synthetic Polynucleotide
LMCHATFTM

SEQ ID NO: 446 - protein, 9 aa, Artificial Sequence
  Synthetic Polynucleotide
MGEAAAIFM

SEQ ID NO: 447 - protein, 9 aa, Artificial Sequence
  Synthetic Polynucleotide
GEAAAIFMT

SEQ ID NO: 448 - protein, 9 aa, Artificial Sequence
  Synthetic Polynucleotide
KTVWFVPSI

SEQ ID NO: 449 - protein, 9 aa, Artificial Sequence
  Synthetic Polynucleotide
LMRRGDLPV

SEQ ID NO: 450 - protein, 9 aa, Artificial Sequence
  Synthetic Polynucleotide
TLLCDIGES

SEQ ID NO: 451 - protein, 9 aa, Artificial Sequence
  Synthetic Polynucleotide
LLCDIGESS

SEQ ID NO: 452 - protein, 9 aa, Artificial Sequence
  Synthetic Polynucleotide
AMTDTTPFG

SEQ ID NO: 453 - protein, 9 aa, Artificial Sequence
  Synthetic Polynucleotide
GQQRVFKEK

SEQ ID NO: 454 - protein, 9 aa, Artificial Sequence
  Synthetic Polynucleotide
KLTYQNKVV

SEQ ID NO: 455 - protein, 9 aa, Artificial Sequence
  Synthetic Polynucleotide
AISGDDCVV

SEQ ID NO: 456 - protein, 9 aa, Artificial Sequence
  Synthetic Polynucleotide
LMYFHRRDL

SEQ ID NO: 457 - protein, 9 aa, Artificial Sequence
  Synthetic Polynucleotide
RTLILAPTR

SEQ ID NO: 458 - protein, 9 aa, Artificial Sequence
  Synthetic Polynucleotide
TLILAPTRV

SEQ ID NO: 459 - protein, 9 aa, Artificial Sequence
  Synthetic Polynucleotide
MCHATFTMR

SEQ ID NO: 460 - protein, 9 aa, Artificial Sequence
  Synthetic Polynucleotide
TVWFVPSIK

SEQ ID NO: 461 - protein, 9 aa, Artificial Sequence
  Synthetic Polynucleotide
GQQRVFKEK

SEQ ID NO: 462 - protein, 9 aa, Artificial Sequence
  Synthetic Polynucleotide
CVYNMMGKR

SEQ ID NO: 463 - protein, 9 aa, Artificial Sequence
  Synthetic Polynucleotide
HTMWHVTRG

SEQ ID NO: 464 - protein, 9 aa, Artificial Sequence
  Synthetic Polynucleotide
RTLILAPTR

SEQ ID NO: 465 - protein, 9 aa, Artificial Sequence
  Synthetic Polynucleotide
TLILAPTRV

SEQ ID NO: 466 - protein, 9 aa, Artificial Sequence
  Synthetic Polynucleotide
MCHATFTMR

SEQ ID NO: 467 - protein, 9 aa, Artificial Sequence
  Synthetic Polynucleotide
ATFTMRLLS

SEQ ID NO: 468 - protein, 9 aa, Artificial Sequence
  Synthetic Polynucleotide
GEAAAIFMT

SEQ ID NO: 469 - protein, 168 aa, Zika Virus
AEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYS

What is claimed is:

1. An immunogenic composition comprising a ribonucleic acid (RNA) polynucleotide having an open reading frame encoding an antigenic Zika virus (ZIKV) prME protein that comprises the amino acid sequence of SEQ ID NO: 203, wherein the RNA polynucleotide is formulated in a lipid nanoparticle that comprises a molar ratio of 20-60% ionizable cationic lipid, 5-25% non-cationic lipid, 25-55% sterol, and 0.5-15% PEG-modified lipid, in an effective amount to induce an immune response in a subject.

2. The immunogenic composition of claim 1, wherein the RNA polynucleotide further encodes at a 5' terminal cap, 7mG(5')ppp(5')N1mpNp.

3. The immunogenic composition of claim 1, wherein at least 80% of the uracil in the open reading frame has a chemical modification selected from N1-methyl-pseudouridine and N1-ethyl-pseudouridine.

4. The immunogenic composition of claim 3, wherein the chemical modification is in the carbon 5-position of the uracil.

5. The immunogenic composition of claim 1, wherein the efficacy of the composition is at least 60%, relative to unvaccinated subjects, following a single dose of the composition.

6. The immunogenic composition of claim 5, wherein the efficacy of the composition is at least 70%, relative to unvaccinated subjects, following a single dose of the composition.

7. The immunogenic composition of claim 6, wherein the efficacy of the composition is at least 80%, relative to unvaccinated subjects, following a single dose of the composition.

8. The immunogenic composition of claim 7, wherein the efficacy of the composition is at least 90%, relative to unvaccinated subjects, following a single dose of the composition.

9. The immunogenic composition of claim 1, wherein the effective amount is sufficient to produce detectable levels of ZIKV prME protein as measured in serum of the subject at 1-72 hours post administration.

10. The immunogenic composition of claim 1, wherein the effective amount is sufficient to produce a 1,000-10,000 neutralization titer produced by neutralizing antibody against the ZIKV prME protein as measured in serum of the subject at 1-72hours post administration.

11. The immunogenic composition of claim 1, wherein an anti-ZIKV prME protein antibody titer produced in the subject is increased by at least 1 log relative to a control, wherein the control is an anti-ZIKV prME protein antibody titer produced in a subject who has not been administered any vaccine against ZIKV.

12. The immunogenic composition of claim 1, wherein the anti-ZIKV prME protein antibody titer produced in the subject is increased at least 2 times relative to a control, wherein the control is an anti-ZIKV prME protein antibody titer produced in a subject who has not been administered any vaccine against ZIKV.

13. The immunogenic composition of claim 1, wherein the effective amount is a total dose of 25 µg-200 µg.

14. The immunogenic composition of claim 13, wherein the effective amount is a total dose of 25 µg-100 µg.

15. The immunogenic composition of claim 1, wherein the ionizable cationic lipid comprises the following compound:

16. The immunogenic composition of claim 1, wherein the RNA polynucleotide has an open reading frame that comprises a nucleotide sequence that has at least 90% identity to the nucleotide sequence of SEQ ID NO: 139.

17. The immunogenic composition claim 16, wherein the RNA polynucleotide has an open reading frame that comprises the nucleotide sequence of SEQ ID NO: 139.

18. The immunogenic composition of claim 1, wherein the ZIKV composition further comprises a RNA polynucleotide having an open reading frame encoding antigenic Chikungunya virus (CHIKV) polyprotein comprising E1 protein and/or E2 protein.

19. The immunogenic composition of claim 18, wherein the antigenic CHIKV polyprotein further comprises C protein, E1 protein, E2 protein and E3 protein.

20. The immunogenic composition of claim 19, wherein the antigenic CHIKV polyprotein comprises an amino acid sequence that has at least 90% identity to the amino acid sequence of SEQ ID NO: 408.

21. The immunogenic composition of claim 19, wherein the RNA polynucleotide having an open reading frame encoding antigenic CHIKV polyprotein comprises a nucleotide sequence that has at least 90% identity to the nucleotide sequence of SEQ ID NO: 401.

22. The immunogenic composition of claim 1, wherein the ZIKV composition further comprises a RNA polynucleotide having an open reading frame encoding antigenic Dengue virus (DENV) polypeptide.

23. The immunogenic composition of claim 22, wherein the antigenic DENV polypeptide comprises an antigenic DENV prME protein.

24. The immunogenic composition of claim 23, wherein the antigenic DENV prME protein comprises an amino acid sequence that has at least 90% identity to the amino acid sequence of SEQ ID NO: 267.

25. The immunogenic composition of claim 23, wherein the RNA polynucleotide having an open reading frame encoding antigenic DENV prME protein comprises a (Compound 25)

nucleotide sequence that has at least 90% identity to the nucleotide sequence of SEQ ID NO: 248.

26. An immunogenic composition comprising a ribonucleic acid (RNA) polynucleotide having an open reading frame encoding an antigenic ZIKV prME protein that comprises the amino acid sequence of SEQ ID NO: 203.

* * * * *